United States Patent
Thompson

(10) Patent No.: US 10,428,347 B2
(45) Date of Patent: Oct. 1, 2019

(54) HERBICIDE-DETOXIFYING ENZYMES AND USES THEREOF

(71) Applicants: Spogen Biotech Inc., St. Louis, MO (US); Nufarm Limited, Laverton North, Victoria (AU)

(72) Inventor: Brian Thompson, Creve Coeur, MO (US)

(73) Assignees: Spogen Biotech Inc., St. Louis, MO (US); Nufarm Limited, Laverton North, Victoria (AU)

( * ) Notice: Subject to any disclaimer, the term of this patent is extended or adjusted under 35 U.S.C. 154(b) by 0 days.

(21) Appl. No.: 16/043,477

(22) Filed: Jul. 24, 2018

(65) Prior Publication Data

US 2019/0024109 A1    Jan. 24, 2019

Related U.S. Application Data

(60) Provisional application No. 62/536,077, filed on Jul. 24, 2017.

(51) Int. Cl.

| | | |
|---|---|---|
| C12N 9/00 | (2006.01) | |
| C12N 15/74 | (2006.01) | |
| A01N 25/12 | (2006.01) | |
| A01N 25/32 | (2006.01) | |
| C12N 15/82 | (2006.01) | |
| C12N 9/04 | (2006.01) | |
| C08G 64/30 | (2006.01) | |
| C12N 9/02 | (2006.01) | |

(52) U.S. Cl.
CPC ......... *C12N 15/8274* (2013.01); *A01N 25/12* (2013.01); *A01N 25/32* (2013.01); *C08G 64/30* (2013.01); *C12N 9/0006* (2013.01); *C12N 9/0071* (2013.01); *C12N 15/74* (2013.01); *C12Y 101/01* (2013.01); *C12Y 114/11* (2013.01); *C12Y 114/13001* (2013.01); *C12Y 114/13002* (2013.01); *C12Y 114/13063* (2013.01); *C12Y 308/01008* (2013.01)

(58) Field of Classification Search
CPC combination set(s) only.
See application file for complete search history.

(56) References Cited

U.S. PATENT DOCUMENTS

| | | |
|---|---|---|
| 2,990,266 A | 6/1961 | Eden |
| 3,538,093 A | 11/1970 | Mason et al. |
| 5,232,484 A | 8/1993 | Pignatello |
| 5,445,962 A | 8/1995 | Atallah et al. |
| 5,725,678 A | 3/1998 | Cannon et al. |
| 6,387,874 B1 | 5/2002 | Schalitz et al. |
| 7,022,896 B1 | 4/2006 | Weeks et al. |
| 7,105,724 B2 | 9/2006 | Weeks et al. |
| 7,183,248 B2 | 2/2007 | Manning, Jr. |
| 7,855,326 B2 | 12/2010 | Feng et al. |
| 8,207,092 B2 | 6/2012 | Bhatti et al. |
| 8,579,544 B2 | 11/2013 | Boulos et al. |
| 2003/0089381 A1 | 5/2003 | Manning, Jr. |
| 2004/0029129 A1 | 2/2004 | Wang et al. |
| 2004/0033897 A1 | 2/2004 | Haas |
| 2009/0093366 A1 | 4/2009 | Wright et al. |
| 2011/0203017 A1 | 8/2011 | Wright et al. |
| 2011/0229450 A1 | 9/2011 | Scott et al. |
| 2015/0126423 A1 | 5/2015 | Herr et al. |
| 2015/0173369 A1 | 6/2015 | Mann et al. |
| 2015/0173370 A1 | 6/2015 | Mann et al. |
| 2015/0173371 A1 | 6/2015 | Mann et al. |

FOREIGN PATENT DOCUMENTS

| | | |
|---|---|---|
| CN | 1984558 B | 1/2011 |
| EP | 0 184 288 A1 | 6/1986 |
| EP | 0 272 002 A1 | 6/1988 |
| EP | 0 515 070 A1 | 11/1992 |
| EP | 0 497 912 B1 | 5/1999 |
| EP | 1 972 686 A1 | 9/2008 |
| WO | 98/45424 A1 | 10/1998 |
| WO | 02/068607 A2 | 9/2002 |
| WO | 02/077183 A2 | 10/2002 |
| WO | 2007/053482 A2 | 5/2007 |
| WO | 2007/146706 A2 | 12/2007 |
| WO | 2009/135259 A1 | 11/2009 |
| WO | 2010/025499 A1 | 3/2010 |
| WO | 2010/039750 A2 | 4/2010 |
| WO | 2013/165905 A1 | 11/2013 |
| WO | 2014/153242 A1 | 9/2014 |

OTHER PUBLICATIONS

Witkowski et al (Biochemistry 38:11643-11650), (Year: 1999).*
Broun et al (Science 282:1315-1317, (Year: 1998).*
Database UniProt_201810 ; Accession Number—(Year: 2016).*
Database UniProt_201810 ; Accession No. A0A1C4ESD8. (Year: 2016).*
Bandounas, L., et al., "Isolation and Characterization of Novel Bacterial Strains Exhibiting Ligninolytic Potential," BMC Biotechnology, 2011, pp. 1-11, vol. 11, No. 94.
Behrens, M., et al., "Dicamba Resistance: Enlarging and Preserving Biotechnology-Based Weed Management Strategies," Science, May 2007, pp. 1185-1188, vol. 316.
Biddinger, D., et al., "Pollinators and Pesticide Sprays During Bloom in Fruit Plantings," Tree Fruit Productions, Penn State College of Agricultural Sciences, 2016, pp. 1-5.
Chishti, Z., et al., "Microbial Degradation of Chlorpyrifos in Liquid Media and Soil," Journal of Environmental Management, 2013, pp. 372-380, vol. 114.

(Continued)

*Primary Examiner* — Padmavathi Baskar

(57) ABSTRACT

Herbicide-detoxifying enzymes, compositions containing one or more of the enzymes, and plant seeds treated with the enzymes are provided. The enzymes can be used in methods for detoxifying auxin herbicides or degrading auxin plant regulators, including in methods for decontaminating surface of an apparatus used in agriculture or pesticide manufacturing, methods for decontaminating water, soil, soilless media, or sludge, and methods for protecting a plant from an auxin herbicide, improving a plant's tolerance to an auxin herbicide, or removing an auxin herbicide from the surface of a plant.

17 Claims, 29 Drawing Sheets

Specification includes a Sequence Listing.

(56) References Cited

OTHER PUBLICATIONS

Gauri, S. S., et al., "Biotransformation of p-Coumaric Acid and 2,4-Dichlorophenoxy Acetic Acid by *Azotobacer* sp. Strain SSB81," Bioresource Technology, 2012, pp. 350-353, vol. 126.

GenBank Accession No. KZD26119, "2-Polyprenyl-6-Methoxyphenol Hydroxylase [*Bacillus cereus*]," accessed from NCBI website at <https://www.ncbi.nlm.nih.gov/protein/1017035677> on Sep. 26, 2018, 12 pages.

GenBank Accession No. Q59713, "Sallcylate Hydroxylase," accessed from NCBI website at <www.ncbi.nih.gov/protein/Q59713> on Sep. 26, 2018, 7 pages.

Germaine, K. J., et al., "Bacterial Endophyte-Enhanced Phytoremediation of the Organochlorine Herbicide 2,4-Dichlorophenoxyacetic Acid," Federation of European Microbiological Societies Microbiol Ecol, 2006, pp. 302-310, vol. 57.

Han, L., et al., "Cloning, Expression, Characterization and Mutational Analysis of the tfdA Gene from Cupriavidus campinensis BJ71," World Journal of Microbiology & Biotechnology, 2015, pp. 1021-1030, vol. 31, No. 7.

Han, L., et al., "Isolation and 2,4-Degrading Characteristics of Cupriavidus campinensis BJ71," Brazilian Journal of Microbiology, 2015, pp. 433-441, vol. 46, No. 2.

Huong, N. L., et al., "Chlorophenol Hydroxylate Activity Encoded by TfdB from 2,4-Dichlorophenoxyacetic Acid (2,4-D)-Degrading *Bradyrhizobium* sp. Strain RD5-C2," Bioscience, Biotechnology, and Biochemistry, 2007, pp. 1691-1696, vol. 71, No. 7.

International Search Report and Written Opinion issued for PCT/US2018/043424 dated Oct. 15, 2018, 7 pages.

Johnson, L M., et al., "Detoxification of Pesticides by Microbial Enzymes," Experientia, 1983, pp. 1236-1246, vol. 39.

Johnson, W. G., et al., "2,4-D- and Dicamba-Tolerant Crops—Some Facts to Consider," Purdue Extension, Nov. 2012, pp. 1-7.

Knutson, A., et al., "Homeowner's Guide to Pests of Peaches, Plums and Pecans," Texas Farmer Collection, 2005, pp. 1-9.

Krueger, J. P., et al., "Isolation and Identification of Microorganisms for the Degradation of Dicamba," Journal of Agricultural Food Chemistry, 1989, pp. 534-538, vol. 37, No. 2.

Krueger, J. P., et al., "Use of Dicamba-Degrading Microorganisms to Protect Dicamba Susceptible Plant Species," ournal of Agricultural Food Chemistry, 1991, pp. 1000-1003, vol. 39, No. 5.

Ledger, T., et al., "Chlorophenol Hydroxylases Encoded by Plasmid pJP4 Differentially Contribute to Chlorophenoxyacetic Acid Degradation," Applied and Environmental Microbiology, Apr. 2006, pp. 2783-2792, vol. 72, No. 4.

Macur, R. E., et al., "Impacts of 2,4-D Application on Soil Microbial Community Structure and on Populations Associated with 2,4-D Degradation," Microbiological Research, 2007, pp. 37-45, vol. 162.

Madhavi, V., et al., "Laccase: Properties and Applications," BioResources, 2009, pp. 1694-1717, vol. 4, No. 4.

Marino, M., "Blowies Inspire Pesticide Attack," CSIRO Solve, Aug. 2007, 3 pages.

Munnecke, D. M., "Chemical, Physical, and Biological Methods for the Disposal and Detoxification of Pesticides," Residue Reviews, 1979, pp. 1-26, Springer, New York, New York.

Munnecke, D. M., et al., "Pathways of Microbial Metabolism of Parathion," Applied and Environmental Microbiology, Jan. 1976, pp. 63-69, vol. 31, No. 1.

Nielsen, T. K., et al., "Novel Insight into the Genetic Context of the cadAB Genes from a 4-chloro-2-methylphenoxyacetic Acid-Degrading Sphingomonas," PLOS One, Dec. 2013, 9 pages, vol. 8, Issue 12, No. e83346.

Ogogbue, C. J., et al., "Bioremediation and Detoxification of Synthetic Wastewater Containing Triarylmethane Dyes by Aeromonas hydrophila Isolated from Industrial Effluent," Biotechnology Research International, 2011, 11 pages, vol. 2011, Article ID 967925.

Robinson, T., et al., "Remediation of Dyes in Textile Effluent: A Critical Review on Current Treatment Technologies with a Proposed Alternative," Bioresource Technology, 2001, pp. 247-255, vol. 77.

Rodriguez-Delgado, M. M., et al., "Laccase-Based Biosensors for Detection of Phenolic Compounds," Trends in Analytical Chemistry, 2015, pp. 21-45, vol. 74.

Russell, R. J., et al., "Enzymatic Bioremediation of Chemical Pesticides," Australasian Biotechnology, 2001, pp. 24-26, vol. 11, No. 3.

Sannino, F., et al., "Oxidative Degradation of Different Chlorinated Phenoxyalkanoic Acid Herbicides by a Hybrid ZrO (sub)2 Gel-Derived Catalyst without Light Irradiation," ACS Applied Materials & Interfaces, 2015, pp. 256-263, vol. 7.

Sciumbato, A. S., et al., "Determining Exposure to Auxin-Like Herbicides. I. Quantifying Injury to Cotton and Soybean," Weed Technology, Oct.-Dec. 2004, pp. 1125-1134, vol. 18, Issue 4.

Scott, C., et al., "The Enzymatic Basis for Pesticide Bioremediation," Indian Journal of Microbiology, Mar. 2008, pp. 65-79, vol. 48, No. 1.

Seeger, M., et al., "Bacterial Degradation and Bioremediation of Chlorinated Herbicides and Biphenyls," Journal of Soil Science and Plant Nutrition, 2010, pp. 320-332, vol. 10, No. 3.

Shimojo, M., et al., "Analysis of Genes Encoding the 2,4-Dichlorophenoxyacetic Acid-Degrading Enzyme from Sphingomonas agrestis 58-1," Journal of Bioscience and Bioengineering, 2009, pp. 56-59, vol. 108, No. 1.

Spaans, S. K., et al., "NADPH-Generating Systems in Bacteria and Archaea," Frontiers in Microbiology, Jul. 2015, pp. 1-27, vol. 6, Article 742.

Subramanian, M. V., et al., "Engineering Dicamba Selectivity in Crops: A Search for Appropriate Degradative Enzyme(s)," Journal of Industrial Microbiology & Biotechnology, 1997, pp. 344-349, vol. 19.

Thompson, M. A., et al., "Soybean Tolerance to Early Preplant Applications of 2,4-D Ester, 2,4-D Amine, and Dicamba," Weed Technology, Oct.-Dec. 2007, pp. 882-885, vol. 21.

Uemura, T., et al., "The Catalytic Mechanism of Decarboxylative Hydroxylation of Salicylate Hydroxylase Revealed by Crystal Structure Analysis at 2.5 A Resolution," Biochemical and Biophysical Research Communications, 2016, pp. 158-163, vol. 469.

United States Environmental Protection Agency, "Atrazine—Background and Updates," Retrieved 2015, 6 pages.

Weckbecker, A., et al., "Glucose Dehydrogenase for the Regeneration of NADPH and NADH," Methods in Biotechnology: Microbial Enzymes and Biotransformations, Chapter 14, 2005, pp. 225-237, vol. 17.

\* cited by examiner

HERBICIDE-DETOXIFYING ENZYMES AND USES THEREOF

CROSS REFERENCE TO RELATED APPLICATIONS

This application claims priority to U.S. Provisional Application No. 62/536,077 filed Jul. 24, 2017, the content of which is incorporated herein by reference in its entirety.

THE NAMES OF PARTIES TO A JOINT RESEARCH AGREEMENT

The claimed invention was made by or on behalf of Elemental Enzymes Ag and Turf, LLC and Nufarm Americas Inc., parties to a joint research agreement in effect before the date of the claims invention, and as a result of activities within the scope of the joint research agreement.

FIELD OF THE INVENTION

Herbicide-detoxifying enzymes, compositions containing one or more of the herbicide-detoxifying enzymes, and plant seeds treated with the enzymes are provided. The enzymes can be used in methods for detoxifying auxin herbicides or degrading auxin plant regulators, including in methods for decontaminating surface of an apparatus used in agriculture or pesticide manufacturing, methods for decontaminating water, soil, soilless media, or sludge, and methods for protecting a plant from an auxin herbicide, improving a plant's tolerance to an auxin herbicide, or removing an auxin herbicide from the surface of a plant.

BACKGROUND OF THE INVENTION

Increasing amounts of pesticides, and herbicides in particular, are being used in agriculture. When a pesticidal composition is applied, a residual amount of the active pesticidal agent typically remains in contact with the equipment used, for example the tank or agricultural vessel to deliver a spray application of the pesticide. This residual pesticide, if not removed from the equipment, can cause significant injury to sensitive plants and non-target crops. In addition, the residual pesticide can contaminate other land and water areas (ponds, lakes, aquaculture farming areas, etc.) and cause unintentional damage. Thus, there is a need in the art for compositions and methods that are capable of selectively detoxifying pesticides and thereby decontaminating a surface or other material (e.g., soil or water) that is contaminated with the pesticide. There is also a need in the art for compositions and methods that can be used to protect plants from herbicide-induced damage (e.g., herbicide drift from volatile herbicides such as dicamba), improve herbicide tolerance of a plant, and remove herbicide residue from the surface of a plant.

BRIEF SUMMARY OF THE INVENTION

An isolated nucleic acid is provided. The isolated nucleic acid comprises a nucleic acid sequence having at least 70%, at least 75%, at least 80%, at least 85%, at least 90%, at least 95%, at least 98%, at least 99%, or 100% identity to any one of SEQ ID NOs. 72, 115, 250, 266, 267, and 294-299.

Another isolated nucleic acid is provided. The isolated nucleic acid comprises a nucleic acid sequence having at least 90%, at least 95%, at least 98%, at least 99%, or 100% identity to SEQ ID NO: 19 or 20.

Yet another isolated nucleic acid is provided. The isolated nucleic acid comprises a nucleic acid sequence having at least 93%, at least 95%, at least 98%, at least 99%, or 100% identity to SEQ ID NO: 16 or 17.

A further isolated nucleic acid is provided. The isolated nucleic acid comprises a nucleic acid sequence having at least 94%, at least 95%, at least 98%, at least 99%, or 100% identity to SEQ ID NO: 15 or 18.

Another isolated nucleic acid is provided. The isolated nucleic acid comprises a nucleic acid sequence having at least 96%, at least 98%, at least 99%, or 100% identity to SEQ ID NO: 13.

An isolated nucleic acid is provided. The isolated nucleic acid comprises a nucleic acid sequence having at least 97%, at least 98%, at least 99%, or 100% identity to any one of SEQ ID NOs. 81, 82, 91, 94, and 101.

Another isolated nucleic acid is provided. The isolated nucleic acid comprises a nucleic acid sequence having at least 98%, at least 99%, or 100% identity to any one of SEQ ID NOs. 77, 78, 80, and 85.

A further isolated nucleic acid is provided. The isolated nucleic acid comprises a nucleic acid sequence having at least 99% or 100% identity to any one of SEQ ID NOs. 7, 11, 88, 98, 102, 103, 113, and 260.

Another isolated nucleic acid is provided. The isolated nucleic acid comprises a nucleic acid sequence having at least 78%, at least 80%, at least 85%, at least 90%, at least 95%, at least 98%, at least 99%, or 100% to SEQ ID NO: 273.

Still another isolated nucleic acid is provided. The isolated nucleic acid comprises a nucleic acid sequence having at least 70%, at least 75%, at least 80%, at least 85%, at least 90%, at least 95%, at least 98%, or at least 99% identity to SEQ ID NO: 273, wherein codon 198 is replaced with a codon that codes for a valine residue A further isolated nucleic acid is provided. The isolated nucleic acid comprises a nucleic acid sequence having at least 78%, at least 80%, at least 85%, at least 90%, at least 95%, at least 98%, at least 99%, or 100% to SEQ ID NO: 274, wherein codon 198 codes for a valine residue Another isolated nucleic acid is provided. The isolated nucleic acid comprises a nucleic acid sequence having at least 97.5%, at least 98%, at least 99%, or 100% identity to SEQ ID NO: 243.

Still another isolated nucleic acid is provided. The isolated nucleic acid comprises a nucleic acid sequence having at least 70%, at least 75%, at least 80%, at least 85%, at least 90%, at least 95%, at least 98%, or at least 99% identity to SEQ ID NO: 243, wherein: codon 84 is replaced with a codon that codes for a non-aromatic amino acid; codon 245 is replaced with a codon that codes for a non-aromatic amino acid; or both codons 84 and 245 are replaced with codons that code for a non-aromatic amino acid.

A further isolated nucleic acid is provided. The isolated nucleic acid comprises a nucleic acid sequence having:
- at least 97%, at least 98%, at least 99%, or 100% identity to SEQ ID NO: 244 or 247, wherein codon 84 codes for a non-aromatic amino acid;
- at least 97%, at least 98%, at least 99%, or 100% identity to SEQ ID NO: 245 or 248, wherein codon 245 codes for a non-aromatic amino acid; or
- at least 97%, at least 98%, at least 99%, or 100% identity to SEQ ID NO: 246 or 249, wherein both codon 84 and codon 245 code for non-aromatic amino acids.

Still another isolated nucleic acid is provided. The isolated nucleic acid comprises a nucleic acid sequence having at least 70%, at least 75%, at least 80%, at least 85%, at least 90%, at least 95%, at least 98%, or at least 99% identity to SEQ ID NO: 250, wherein:

codon 83 is replaced with a codon that codes for a non-aromatic amino acid;

codon 241 is replaced with a codon that codes for a non-aromatic amino acid; or both codons 83 and 241 are replaced with codons that code for a non-aromatic amino acid.

Still another isolated nucleic acid is provided. The isolated nucleic acid comprising a nucleic acid sequence having at least 70%, at least 75%, at least 80%, at least 85%, at least 90%, at least 95%, at least 98%, or at least 99% identity to SEQ ID NO: 250, wherein: codon 83 is replaced with a codon that codes for a non-aromatic amino acid; codon 241 is replaced with a codon that codes for a non-aromatic amino acid; or both codons 83 and 241 are replaced with codons that code for a non-aromatic amino acid.

Still another isolated nucleic acid is provided. The isolated nucleic acid comprising a nucleic acid sequence having: at least 70%, at least 75%, at least 80%, at least 85%, at least 90%, at least 95%, at least 98%, at least 99%, or 100% identity to SEQ ID NO: 294 or 295, wherein codon 83 codes for a non-aromatic amino acid; at least 70%, at least 75%, at least 80%, at least 85%, at least 90%, at least 95%, at least 98%, at least 99%, or 100% identity to SEQ ID NO: 296 or 297, wherein codon 241 codes for a non-aromatic amino acid; or at least 70%, at least 75%, at least 80%, at least 85%, at least 90%, at least 95%, at least 98%, at least 99%, or 100% identity to SEQ ID NO: 298 or 299, wherein both codons 83 and 241 code for non-aromatic amino acids.

Still another isolated nucleic acid is provided. The isolated nucleic acid comprises a nucleic acid sequence having at least 76%, at least 78%, at least 80%, at least 85%, at least 90%, at least 95%, at least 98%, at least 99%, or 100% identity to SEQ ID NO: 279

Still another isolated nucleic acid is provided. The isolated nucleic acid comprising a nucleic acid sequence having at least 78%, at least 80%, at least 85%, at least 90%, at least 95%, at least 98%, at least 99%, or 100% identity to SEQ ID NO: 275.

Still another isolated nucleic acid is provided. The isolated nucleic acid comprising a nucleic acid sequence having at least 83%, at least 85%, at least 90%, at least 95%, at least 98%, at least 99%, or 100% identity to SEQ ID NO: 264 or 265.

Still another isolated nucleic acid is provided. The isolated nucleic acid comprising a nucleic acid sequence having at least 89%, at least 90%, at least 95%, at least 98%, at least 99%, or 100% identity to SEQ ID NO: 259.

An isolated nucleic acid is provided. The isolated nucleic acid comprises SEQ ID NO: 2, 3, 5, 7, 8, 11, 12, 13, 15, 16, 17, 18, 19, 20, 72, 77, 78, 80, 81, 82, 83, 84, 85, 86, 88, 91, 94, 96, 98, 99, 100, 101, 102, 103, 109, 112, 113, 114, 115, 243, 244, 245, 246, 247, 248, 249, 250, 259, 260, 264, 265, 266, 267, 273, 274, 275, 279, 294, 295, 296, 297, 298, or 299. Alternatively, the isolated nucleic acid consists of SEQ ID NO: 2, 3, 5, 7, 8, 11, 12, 13, 15, 16, 17, 18, 19, 20, 72, 77, 78, 80, 81, 82, 83, 84, 85, 86, 88, 91, 94, 96, 98, 99, 100, 101, 102, 103, 109, 112, 113, 114, 115, 243, 244, 245, 246, 247, 248, 249, 259, 260, 264, 265, 266, 267, 273, 274, 275, 279, 294, 295, 296, 297, 298, or 299.

A vector comprising any of the isolated nucleic acids is provided. The vector also comprises a heterologous nucleic acid sequence.

A host cell comprising the vector is provided.

An isolated enzyme is provided. The isolated enzyme comprises an amino acid sequence having at least 70%, at least 75%, at least 80%, at least 85%, at least 90%, at least 95%, at least 98%, or at least 99% identity to any one of SEQ ID NOs. 21-39, 41-70, 73, 126-138 140-178, 251-258, 262, 268, 269, 270, 271, 272, 276, 277, 278, 281, 284, and 300-305, wherein the amino acid sequence comprises a substitution of the methionine at the first position of the sequence with a valine.

Another isolated enzyme is provided. The isolated enzyme comprises an amino acid sequence having at least 70%, at least 75%, at least 80%, at least 85%, at least 90%, at least 95%, at least 98%, or at least 99% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

Yet another isolated enzyme is provided. The isolated enzyme comprises an amino acid sequence having at least 70%, at least 75%, at least 80%, at least 85%, at least 90%, at least 95%, at least 98%, or at least 99% identity to SEQ ID NO: 40, 71, or 261, wherein the amino acid sequence comprises a substitution of the valine at the first position of the sequence with a leucine.

A further isolated enzyme is provided. The isolated enzyme comprises an amino acid sequence having at least 70%, at least 75%, at least 80%, at least 85%, at least 90%, at least 95%, at least 98%, or at least 99% identity to SEQ ID NO: 139, wherein the amino acid sequence comprises a substitution of the leucine at the first position of the sequence with a methionine or valine.

Still another isolated enzyme is provided. The isolated enzyme comprises an amino acid sequence having at least 99.3%, at least 99.5%, or 100% identity to SEQ ID NO: 251.

Still another isolated enzyme is provided. The isolated enzyme comprises an amino acid sequence having at least 70%, at least 75%, at least 80%, at least 85%, at least 90%, at least 95%, at least 98%, or at least 99% identity to SEQ ID NO: 251, wherein the phenylalanine residue at amino acid position 84 of SEQ ID NO: 251 is substituted with a non-aromatic amino acid; the tyrosine residue at amino acid position 245 of SEQ ID NO: 251 is substituted with a non-aromatic acid; or both the phenylalanine residue at amino acid position 84 of SEQ ID NO: 251 and the tyrosine residue at amino acid position 245 of SEQ ID NO: 251 are substituted with non-aromatic amino acids.

Still another isolated enzyme is provided. The isolated enzyme comprises an amino acid sequence having at least 70%, at least 75%, at least 80%, at least 85%, at least 90%, at least 95%, at least 98%, or at least 99% identity to SEQ ID NO: 258, wherein the phenylalanine residue at amino acid at position 83 of SEQ ID NO: 258 is substituted with a non-aromatic amino acid; the phenylalanine residue at amino acid at position 241 of SEQ ID NO: 258 is substituted with a non-aromatic amino acid; or both the phenylalanine residue at amino acid at position 83 of SEQ ID NO: 258 and the phenylalanine residue at amino acid at position 241 of SEQ ID NO: 258 are substituted with non-aromatic amino acids.

Still another isolated enzyme is provided. The isolated enzyme can comprise SEQ ID NO: 251, 252, 253, 254, 255, 256, 257, 300, 301, 302, 303, 304, or 305. Alternatively, the isolated enzyme can consist of SEQ ID NO: 251, 252, 253, 254, 255, 256, 257, 300, 301, 302, 303, 304, or 305.

Still another isolated enzyme is provided. The isolated enzyme can comprise an amino acid sequence having at least 70%, at least 75%, at least 80%, at least 85%, at least 90%, at least 95%, at least 98%, or at least 99% identity to SEQ ID NO: 276, wherein the alanine residue at position 198 of SEQ ID NO: 276 is replaced with a valine residue.

Yet another isolated enzyme is provided. The isolated enzyme can comprise SEQ ID NO: 277 or the isolated enzyme can consist of SEQ ID NO: 277.

Another isolated enzyme is provided. The isolated enzyme comprises an amino acid sequence having at least 98.5%, at least 99%, or 100% identity to SEQ ID NO: 261.

Still another isolated enzyme is provided. The isolated enzyme comprises an amino acid sequence having at least 99% or 100% identity to SEQ ID NO: 272

Still another isolated enzyme is provided. The isolated enzyme comprises an amino acid sequence having at least 99.8% or 100% identity to SEQ ID NO: 269.

Still another isolated enzyme is provided. The enzyme can comprise SEQ ID NO: 261, 269, 270, or 272. Alternatively, the enzyme can consist of SEQ ID NO: 261, 269, 270, or 272.

A composition comprising a carrier and any of the isolated enzymes is provided.

Another composition is provided. The composition comprises a carrier and an enzyme that comprises an amino acid sequence having at least 70%, at least 75%, at least 80%, at least 85%, at least 90%, at least 95%, at least 98%, at least 99%, or 100% identity to any one of SEQ ID NOs. 21-71, 73, 126-178, 251-258, 261, 262, 268-272, 276-278, 281, 284, and 300-305.

Yet another composition is provided. The composition comprises a carrier. The composition also comprises a first enzyme. The first enzyme comprises a monooxygenase, a phenolic acid decarboxylase, or a chlorohydrolase. The composition further comprises a second enzyme. The second enzyme comprises a monooxygenase, a phenolic acid decarboxylase, or a chlorohydrolase. The first enzyme and the second enzyme are different from one another.

A composition is provided. The composition comprises an agriculturally acceptable carrier and an enzyme. The enzyme comprises a monooxygenase, a phenolic acid decarboxylase, a chlorohydrolase, or a combination of any thereof. The composition further comprises a pesticide. The enzyme is not capable of degrading the pesticide.

Still another composition is provided. The composition comprises a carrier. The composition also comprises a 2,4-D-alpha ketoglutarate dioxygenase enzyme comprising an amino acid sequence having at least 70%, at least 75%, at least 80%, at least 85%, at least 90%, at least 95%, at least 98%, at least 99%, or 100% identity to any one of SEQ ID NOs. 276-278; and a hydroxylase enzyme comprising an amino acid sequence having at least 70%, at least 75%, at least 80%, at least 85%, at least 90%, at least 95%, at least 98%, at least 99%, or 100% identity to SEQ ID NO: 281.

A plant seed is provided. The plant seed is treated with any of the isolated enzymes or any of the compositions.

Another plant seed is provided. The plant seed is treated with at least one enzyme. The enzyme comprises a monooxygenase, a phenolic acid decarboxylase, a chlorohydrolase, or a combination of any thereof.

A method for detoxifying an auxin herbicide or degrading an auxin plant growth regulator is provided. The method comprises contacting the auxin herbicide or the auxin plant growth regulator with any of the isolated enzymes or any of the compositions.

Another method for detoxifying an auxin herbicide or degrading an auxin plant growth regulator is provided. The method comprises contacting the auxin herbicide or the auxin plant growth regulator with an enzyme. The enzyme comprises:
  a salicylate monooxygenase;
  a hydroxyphenylacetate monooxygenase;
  a hydroxybenzoate monooxygenase;
  a monooxygenase comprising an amino acid sequence having at least 70%, at least 75%, at least 80%, at least 85%, at least 90%, at least 95%, at least 98%, at least 99%, or 100% identity to any one of SEQ ID NOs. 21-71, 251-258, 261, 262, 268-272, and 300-305;
  a phenolic acid decarboxylase comprising an amino acid sequence having at least 70%, at least 75%, at least 80%, at least 85%, at least 90%, at least 95%, at least 98%, at least 99%, or 100% identity to SEQ ID NO: 73;
  a chlorohydrolase that is capable of detoxifying the auxin herbicide or degrading the auxin plant growth regulator; or
  a combination of any thereof.

Yet another method for detoxifying an auxin herbicide or degrading an auxin plant growth regulator is provided. The method comprises contacting the auxin herbicide or the auxin plant growth regulator with a first enzyme and a second enzyme. The first and second enzymes are different from one another.

Another method for detoxifying an auxin herbicide or an auxin plant growth regulator is provided. The method comprises contacting the auxin herbicide or the auxin plant growth regulator with an enzyme. The enzyme comprises a monooxygenase, a phenolic acid decarboxylase, a chlorohydrolase, or a combination of any thereof. The method further comprises contacting the auxin herbicide with a pesticide. The enzyme is not capable of degrading the pesticide.

Another method for detoxifying an auxin herbicide or an auxin plant growth regulator is provided. The method comprises contacting the auxin herbicide or the auxin plant growth regulator with: (a) a 2,4-D-alpha ketoglutarate dioxygenase enzyme comprising an amino acid sequence having at least 70%, at least 75%, at least 80%, at least 85%, at least 90%, at least 95%, at least 98%, at least 99%, or 100% identity to any one of SEQ ID NOs. 276-278; and (b) a hydroxylase enzyme comprising an amino acid sequence having at least 70%, at least 75%, at least 80%, at least 85%, at least 90%, at least 95%, at least 98%, at least 99%, or 100% identity to SEQ ID NO: 281; and/or (b) a ring-cleaving dioxygenase enzyme comprising an amino acid sequence having at least 95%, at least 98%, at least 99%, or 100% identity to SEQ ID NO: 283.

Any of the methods for detoxifying an auxin herbicide or an auxin plant growth regulator can comprise a method for decontaminating a surface of an apparatus used in agriculture or pesticide manufacturing, wherein the surface is contaminated with the auxin herbicide or the auxin plant growth regulator. The method comprises contacting the surface with the enzyme or enzymes.

A method for decontaminating a surface of an apparatus used in agriculture or pesticide manufacturing is provided. The surface is contaminated with an auxin herbicide or an auxin plant growth regulator. The method comprises contacting the surface with an enzyme. The enzyme comprises a free monooxygenase.

Another for decontaminating a surface of an apparatus used in agriculture or pesticide manufacturing is provided. The surface is contaminated with an auxin herbicide or an auxin plant growth regulator. The method comprises contacting the surface with an enzyme. The enzyme comprises a phenolic acid decarboxylase.

Any of the methods for detoxifying an auxin herbicide or an auxin plant growth regulator can comprise a method for decontaminating water, soil, soilless media, or sludge, wherein the water, soil, soilless media, or sludge is contaminated with the auxin herbicide or the auxin plant growth regulator. The method comprises contacting the water, soil, soilless media, or sludge with the enzyme or enzymes.

A method for decontaminating soil, soilless media, water, or sludge is provided. The soil, soilless media, water, or sludge is contaminated with an auxin herbicide or an auxin plant growth regulator. The method comprises contacting the soil, soilless media, water, or sludge, with an enzyme. The enzyme comprises a free monooxygenase or a free phenolic acid decarboxylase.

Another method for decontaminating water, soilless media, or sludge is provided. The water or sludge is contaminated with an auxin herbicide or an auxin plant growth regulator. The method comprises contacting the water, soilless media, or sludge with an enzyme. The enzyme comprises a phenolic acid decarboxylase.

Any of the methods for detoxifying an auxin herbicide or an auxin plant growth regulator can comprise a method for protecting a plant from the auxin herbicide, for improving a plant's tolerance for the auxin herbicide, or for removing the auxin herbicide from a surface of a plant. The method comprises applying the enzyme or enzymes to a plant, a plant seed, plant growth medium, or an area surrounding a plant or a plant seed.

A method for protecting a plant from an auxin herbicide, for improving a plant's tolerance for an auxin herbicide, or for removing an auxin herbicide from a surface of a plant is provided. The method comprises applying any of the enzymes or any of the compositions to a plant, a plant seed, plant growth medium, or an area surrounding a plant or a plant seed.

Another method for protecting a plant from an auxin herbicide, for improving a plant's tolerance for an auxin herbicide, or for removing an auxin herbicide from a surface of a plant is provided. The method comprises applying an enzyme to a plant, a plant seed, plant growth medium, or an area surrounding a plant or a plant seed. The enzyme comprises a monooxygenase, a phenolic acid decarboxylase, a chlorohydrolase, or a combination of any thereof.

The features of the invention are further defined in the appended claims. Other objects and features will be in part apparent and in part pointed out hereinafter.

Figure 1:
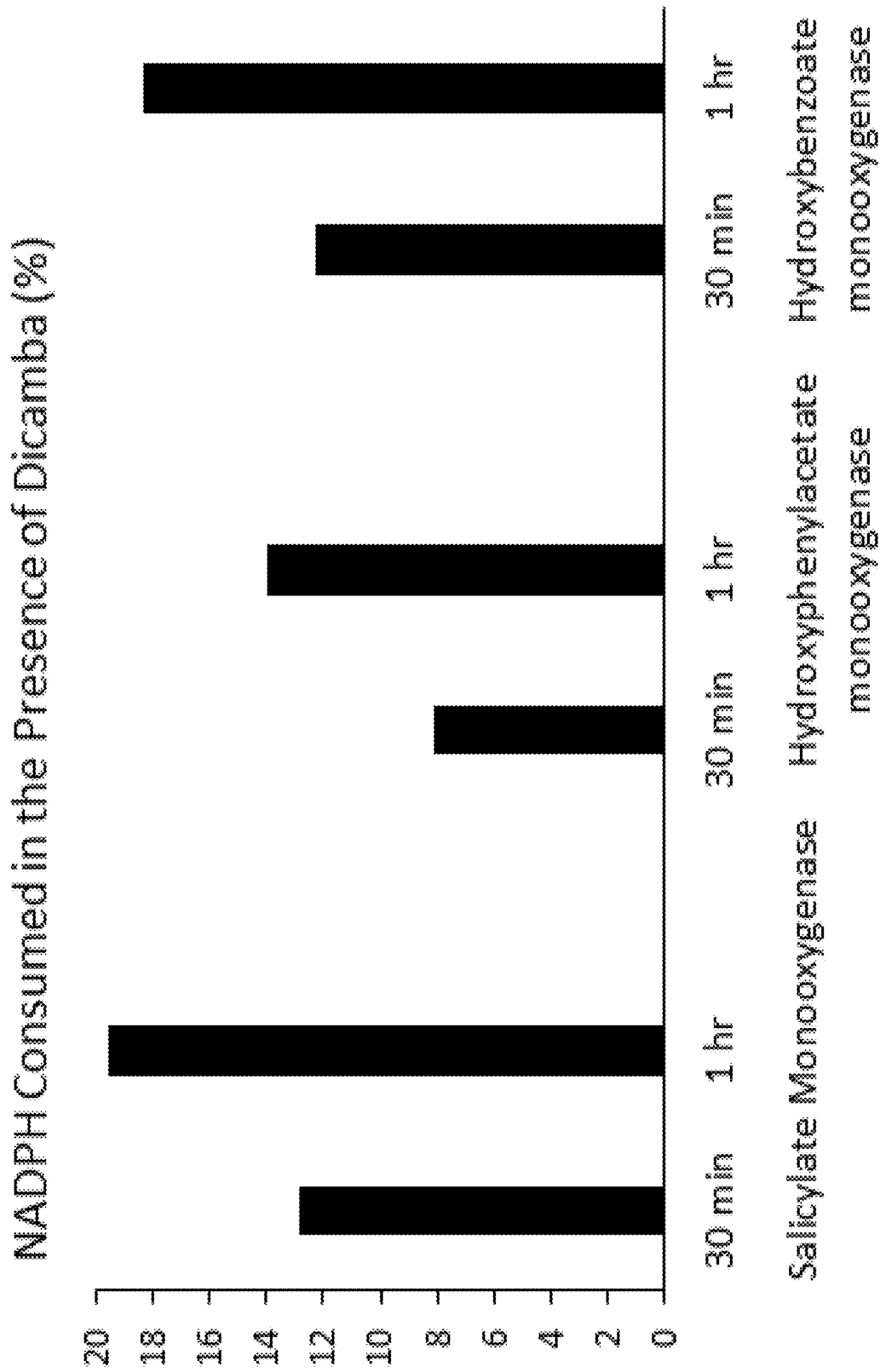
FIG. 1 is a bar graph of illustrative results showing the percent of NADPH consumed during detoxification of dicamba by immobilized salicylate monooxygenase (SM), immobilized hydroxyphenylacetate monooxygenase (HPAM), or immobilized hydroxybenzoate monooxygenase (HBM), over the course of 30 minutes or one hour.

The term "partially purified" as used herein in reference to the enzymes means that a crude preparation of the enzyme (e.g., a cell lysate) has been subjected to procedures that remove at least some non-enzyme components (e.g., waste proteins, dead cell material, excess water, and/or unwanted cell debris). In a partially purified enzyme preparation, the enzyme preferably comprises at least 1% of the total protein content in the preparation, more preferably at least 3% of the total protein content in the preparation, and even more preferably greater than 5% of the total protein content in the preparation.

The term "substantially purified" as used herein in reference to the enzymes means that the enzyme preparation has been subjected to procedures that remove a substantial amount of non-enzyme components (e.g., waste proteins, dead cell material, excess water, and/or unwanted cell debris). In a substantially purified enzyme preparation, the enzyme preferably comprises greater than 30% of the total protein content in the preparation, more preferably greater than about 40% of the total protein content in the preparation, and even more preferably greater than 50% of the total protein content in the preparation.

A "plant growth medium" includes any material that is capable of supporting the growth of a plant.

The term "post-emergent" as used herein refers application of an herbicide to an area after a plant emerges visibly from the soil.

The term "pre-emergent" as used herein refers to application of an herbicide to an area before a plant emerges visibly from the soil.

The term "pre-plant incorporation" as used herein refers to the incorporation of an herbicide into the soil prior to planting and/or seed treatment prior to planting.

The terms "selectively detoxify" and "selectively degrade" as used in reference to the enzymes described herein indicate the enzymes and thus exert their activity primarily upon their auxin herbicide or auxin plant growth regulator substrates, while having minimal or no effect on non-target compounds. However, it will be understood that the enzymes retain their activity on their natural substrates (e.g., salicylate monooxygenases will degrade salicylate in addition to auxin herbicides and auxin plant growth regulators).

The term "sludge" as used herein refers to any thick, soft, wet mud or a similar viscous mixture of liquid and solid components, especially the product of an industrial or refining process. "Sludge" includes industrial waste material that is mix of liquid and solids.

The term "soilless medium" or "soilless media" as used herein refers to any medium that can support the growth of the plant but does not contain soil. Examples of soilless media include, but are not limited to, sand, potting mix, vermiculite, perlite, dolomite, peat, mulch, hyroponic media and combinations of any thereof.

The term "synergistically effective amount" as used herein refers an amount of a first substance (e.g., a first enzyme) that when used in combination with a second substance (e.g., a second enzyme) that produces a biological effect that is greater than the sum of the biological effects of each of the respective first and second substances when used alone.

DETAILED DESCRIPTION OF THE INVENTION

The present invention is generally directed to herbicide-detoxifying enzymes and compositions containing the herbicide-detoxifying enzymes. The present invention is also directed to plant seeds treated with the enzymes.

The enzymes can be used in methods for detoxifying auxin herbicides or degrading auxin plant regulators. For example, the enzymes can be used in methods for decontaminating surface of an apparatus used in agriculture or pesticide manufacturing. The enzymes can also be used in methods for decontaminating water, soil, soilless media, or sludge. Moreover, the enzymes can be used and methods for protecting a plant from an auxin herbicide, improving a plant's tolerance to an auxin herbicide, or removing an auxin herbicide from the surface of a plant.

I. Herbicide-Detoxifying Enzymes

As described in greater detail hereinbelow in the Examples, the genomes of microbes in microbial libraries that contained microorganisms capable of degrading dicamba or 2,4-D were screened to identify enzymes capable of degrading chemical substrates containing a benzene or phenoxy ring. This screening resulted in identification of a number of monooxygenases, a phenolic acid decarboxylase, and a number of chlorohydrolases.

As described further hereinbelow, monooxygenases, phenolic acid decarboxylases, and chlorohydrolases can be used to detoxify auxin herbicides and to degrade auxin plant growth regulators. For example, monooxygenases, phenolic acid decarboxylases, and chlorohydrolases can be used to promote accelerated degradation of a pesticide, as compared to the rate of degradation that would occur in the absence of the monooxygenase, phenolic acid decarboxylase, or chlorohydrolase.

The monooxygenases, phenolic acid decarboxylases, and chlorohydrolases can be used selectively detoxify auxin herbicides or to selectively degrade auxin plant growth regulators.

A. Monooxygenases

Monooxygenase are classified as oxidoreductases and catalyzes an electron transfer reaction that incorporates one hydroxyl group into a substrate. In reactions catalyzed by monooxygenases, the two atoms of dioxygen are reduced to one hydroxyl group and one $H_2O$ molecule by the concomitant oxidation of NADPH.

The monooxygenases suitable for use in connection with the compositions, seeds, and methods described herein can detoxify an auxin herbicide and/or degrade an auxin plant growth regulator (e.g., dicamba or 2,4-D), or a metabolic product thereof.

Monooxygenases can use NAPDH as a cofactor. Accordingly, the activity of monooxygenases can be monitored by using in vitro methods that detect the consumption of NADPH. For example, since NADPH has an absorbance maximum at approximately 340 nm, the consumption of NADPH can be detected spectrophotometrically by monitoring absorbance at 340 nm over time. The amount of NADPH consumed is proportional to the activity of the monooxygenase, e.g., in detoxifying dicamba or 2,4-D to their non-toxic end products.

The monooxygenases identified through screening of the microbial library were further classified on the basis of being capable of using salicylic acid, hydroxyphenylacetate, or hydroxybenzoate as a substrate based on the active substrates of related proteins identified as being homologous in BLAST search results.

Salicylate monooxygenases include, but are not limited to, salicylate 1-monooxygenases, salicylate1-hydrolases, and salicylate hydrolases. Salicylate monooxygenases are classified as monooxygenases that catalyze the stoichiometric formation of catechol from salicylate and reduced pyridine nucleotide in the presence of a specific cofactor or combination of co-factors with metal ions. A reaction scheme for the degradation of salicylate by a salicylate monooxygenase is shown below:

Salicylate+NADH+$O_2$ → catechol+NAD(+)+$H_2O$+$CO_2$

A reaction scheme for detoxification of dicamba by salicylate monooxygenase is shown below:

Dicamba+NADH/NADPH+2$H^+O_2$ → 3,6-Dichloro-2-methoxyphenol+$NAD^+$/$NADP^+H_2O$+$CO_2$ Alternative names for salicylate monooxygenases include salicylate 1-monoxgenase, salicylate 1-hydroxylase, salicylate hydroxylase, and salicylic hydroxylase. The Enzyme Commission (EC) number for salicylate monooxygenases is 1.14.13.1.

Salicylate monooxygenases can use NAD, NADH, or FAD as cofactors.

Hydroxyphenylacetate monooxygenases include, but are not limited to, 4-hydroxyphenylacetate-3-hydroxylases. Hydroxyphenylacetate monooxygenases are classified from a group of enzymes that function in the catalysis of 4-hydroxyphenylacetate. While most known flavin monooxygenases use NADH or NADPH as substrates (and use the flavins FAD or FMN as prosthetic groups), 4-hydroxyphenylacetate-3-hydroxylase is part of a two-component system, in which a flavin oxidoreductase partner regenerates $FADH_2$ by oxidizing NADH to $NAD^+$.

Hydroxyphenylacetate monooxygenases convert dicamba to 3,4-dihydroxyphenylacetate and water. Hydroxyphenylacetate monooxygenases can use NADH or $FADH_2$ as cofactors in this detoxification reaction. A sample reaction scheme for the degradation of 4-hydroxyphenylacetate by a hydroxyphenylacetate monooxygenase is shown below:

4-hydroxyphenylacetate+NADPH/NADH+$O_2$ → 3,4-dihydroxyphenylacetate+NAD+/NADP++$H_2O$ A reaction scheme for detoxification of dicamba by a hydroxyphenylacetate monooxygenase is shown below:

Dicamba+NADH/NADPH+$O_2$ → 3,6-dichloro-4-hydroxy-2-methoxybenzoic acid+$NAD^+$/$NADP^+$+$H_2O$ Alternative names for hydroxyphenylacetate monooxygenases include 4 HPA 3-hydroxylase,4-hydroxyphenylacetic acid-3-hydroxylase, and p-hydroxy-phenylacetate 3-hydroxylase. The Enzyme Commission (EC) number for hydroxyphenylacetate monooxygenases is 1.14.14.9 (formerly 1.14.13.3).

Hydroxyphenylacetate monooxygenases use NAD, NADH, FAD, or FMN as cofactors.

Hydroxybenzoate monooxygenases are classified from a group of oxidoreductases that catalyze hydroxybenzoate, specifically those acting on paired donors, with $O_2$ as oxidant and incorporation or reduction of oxygen. The oxygen incorporated need not be derived from $O_2$ with NADH or NADPH as one donor, and incorporation of one atom of oxygen into the other donor.

Hydroxybenzoate monooxygenases can convert dicamba to 3,4-dihydroxyphenylacetate and water. NADPH is consumed by hydroxybenzoate monooxygenase as the enzyme detoxifies dicamba to its end products. A sample reaction scheme for degradation of 4-hydroxybenzoate by a hydroxybenzoate monooxygenase is shown below:

4-hydroxybenzoate+NADPH+H++$O_2$ → protocatechuate+NADP++$H_2O$.

A reaction scheme for detoxification of dicamba by a hydroxybenzoate monooxygenase is shown below:

Dicamba+NADPH+$H^+O_2$ → 3,6-dichloro-4-hydroxy-2-methoxybenzoic acid+$NADP^+$+$H_2O$ Alternative names for hydroxybenzoate monooxygenases include 4-hydroxybenzoate 3-monooxygenase, p-hydroxybenzoate hydroxylase, p-hydroxybenzoic acid hydroxylase, and para-hydroxybenzoate hydroxylase. The Enzyme Commission (EC) number for hydroxybenzoate monooxygenases is 1.14.13.2.

Hydroxybenzoate monooxygenases use FAD as a cofactor.

For ease of reference, the nucleic acid sequences for the monooxygenases are provided in Table 1 below, together with the bacterial strain from which each monooxygenase was derived and their SEQ ID NOs. The amino acid sequences for each of these monooxygenases are provided in Table 2 below.

TABLE 1

Nucleotide sequences for Monooxygenases.

| Enzyme | SEQ ID NO. for nucleotide sequence |
|---|---|
| Salicylate monooxygenase (*Bacillus cereus* BGSC 6E1 (SM2)) | 1 |
| FAD binding-monooxygenase (*Bacillus thuringiensis* serovar *plusiensis* BGSC 4CC1) | 2 |
| Monooxygenase (*Bacillus cereus* NVH0597-99) | 3 |
| FAD-dependent monooxygenase (*Bacillus cereus* E33L) | 4 |
| FAD binding-monooxygenase (*Bacillus thuringiensis* serovar *andalousiensis* BGSC 4AW10) | 5 |
| Monooxygenase (*Bacillus cereus* H3081.97) | 6 |
| FAD binding-monooxygenase (*Bacillus cereus* m1293) | 7 |
| FAD binding-monooxygenase (*Bacillus cereus* Rock3-42) | 8 |
| FAD-dependent monooxygenase (*Bacillus thuringiensis* serovar *konkukian* str. 97-27) | 9 |
| Hydroxyphenylacetate monooxygenase (*Bacillus cereus* BGSC 6E1) | 10 |
| anthranilate 3-monooxygenase oxygenase component (*Bacillus cereus* JRS1) | 11 |
| 4-hydroxy-phenylacetate 3-monooxygenase oxygenase component (Bacillus cereus BAG2O-3) | 12 |
| 4-hydroxy-phenylacetate 3-monooxygenase oxygenase component (*Bacillus cereus* HuA4-10) | 13 |
| 4-hydroxy-phenylacetate 3-monooxygenase oxygenase component (*Bacillus cereus* ATCC 4342 DJ86) | 14 |
| 4-hydroxy-phenylacetate 3-monooxygenase oxygenase component (*Bacillus cereus* BAGX1-2) | 15 |
| 4-hydroxy-phenylacetate 3-monooxygenase oxygenase component (*Bacillus cereus* VDM053) | 16 |
| 4-hydroxy-phenylacetate 3-monooxygenase oxygenase component (*Bacillus cereus* BAG1X1-3) | 17 |
| 4-hydroxy-phenylacetate 3-monooxygenase oxygenase component (*Bacillus cereus* VD107) | 18 |
| 4-hydroxy-phenylacetate 3-monooxygenase oxygenase component (*Bacillus mycoides* str. BHP DJ93) | 19 |
| Hydroxybenzoate monooxygenase (*Bacillus cereus* BGSC 6E1) | 20 |
| Salicylate monooxygenase (SM1) (*Bacillus cereus* strain B377) | 243 |
| Salicylate monooxygenase (SM3) (*Pseudommas putida* SM3) | 250 |
| Hydroxybenzoate monooxygenase (*Bacillus pseudomycoides* strain B366) | 259 |
| Hydroxyphenylacetate monooxygenase (*Bacillus cereus* strain B363) | 260 |
| Dicamba methyltransferase (*Sphingomonas* sp. Strain Nbdn-20) | 263 |

TABLE 1-continued

Nucleotide sequences for Monooxygenases.

| Enzyme | SEQ ID NO. for nucleotide sequence |
|---|---|
| Dicamba monooxygenase (*Stenotrophomonas maltophilia* DI-6) | 264 |
| Dicamba monooxygenase (*Stenotrophomonas maltophilia* DI-6) | 265 |
| SMO monooxygenase (*Sphingomonas* sp. SRS2) | 266 |
| SMOm monooxygenase (SRS2mutant) (*Sphingomonas* sp. SRS2) | 267 |

TABLE 2

Amino Acid sequences for Monooxygenases

| Enzyme (SEQ ID NO) | SEQ ID NO. for amino acid sequence |
|---|---|
| Salicylate monooxygenase (*Bacillus cereus* BGSC 6E1 (SM2)) | 21 |
| FAD binding-monooxygenase (*Bacillus thuringiensis* serovar *plusiensis* BGSC 4CC1) | 22 |
| Monooxygenase (*Bacillus cereus* NVH0597-99) | 23 |
| FAD-dependent monooxygenase (*Bacillus cereus* E33L) | 24 |
| FAD binding-monooxygenase (*Bacillus thuringiensis* serovar *andalousiensis* BGSC 4AW1) | 25 |
| Monooxygenase (*Bacillus cereus* H3081.97) | 26 |
| FAD binding-monooxygenase (*Bacillus cereus* m1293) | 27 |
| FAD binding-monooxygenase (*Bacillus cereus* Rock3-42) | 28 |
| FAD-dependent monooxygenase (*Bacillus thuringiensis* serovar *konkukian* str. 97-27) | 29 |
| Hydroxyphenylacetate monooxygenase (*Bacillus cereus* BGSC 6E1) | 30 |
| anthranilate 3-monooxygenase oxygenase component (*Bacillus cereus* JRS1) | 31 |
| 4-hydroxy-phenylacetate 3-monooxygenase oxygenase component (*Bacillus cereus* BAG2O-3) | 32 |
| 4-hydroxy-phenylacetate 3-monooxygenase oxygenase component (*Bacillus cereus* HuA4-10) | 33 |
| 4-hydroxy-phenylacetate 3-monooxygenase oxygenase component (*Bacillus cereus* ATCC 4342 DJ86) | 34 |
| 4-hydroxy-phenylacetate 3-monooxygenase oxygenase component (*Bacillus cereus* BAGX1-2) | 35 |
| 4-hydroxy-phenylacetate 3-monooxygenase oxygenase component (*Bacillus cereus* VDM053) | 36 |
| 4-hydroxy-phenylacetate 3-monooxygenase oxygenase component (*Bacillus cereus* BAG1X1-3) | 37 |

TABLE 2-continued

Amino Acid sequences for Monooxygenases

| Enzyme (SEQ ID NO) | SEQ ID NO. for amino acid sequence |
|---|---|
| 4-hydroxy-phenylacetate 3-monooxygenase oxygenase component (*Bacillus cereus* VD107) | 38 |
| 4-hydroxy-phenylacetate 3-monooxygenase oxygenase component (*Bacillus mycoides* str. BHP DJ93) | 39 |
| Hydroxybenzoate monooxygenase (*Bacillus cereus* BGSC 6E1) | 40 |
| Salicylate monooxygenase (SM1) (*Bacillus cereus* strain B377) | 251 |
| Salicylate monooxygenase (*Pseudommas putida* SM3) | 258 |
| Hydroxybenzoate monooxygenase (*Bacillus pseudomycoides* strain B366) | 261 |
| Hydroxyphenylacetate monooxygenase (*Bacillus cereus* strain B363) | 262 |
| Dicamba methyltransferase (*Sphingomonas* sp. Strain Nbdn-20) | 268 |
| Dicamba monooxygenase (*Stenotrophomonas maltophilia* DI-6) | 269 |
| Dicamba monooxygenase (*Stenotrophomonas maltophilia* DI-6) | 270 |
| SMO monooxygenase (*Sphingomonas* sp. SRS2) | 271 |
| SMOm monooxygenase (SRS2mutant) (*Sphingomonas* sp. SRS2) | 272 |

Preferred monooxygenases include the salicylate monooxygenase isolated from *Bacillus cereus* BGSC 6E1, having the nucleotide sequence provided in SEQ ID NO: 1 and the amino acid sequence provided in SEQ ID NO: 21; the hydroxyphenylacetate monooxygenase isolated from *Bacillus cereus* BGSC 6E1, having the nucleotide sequence provided in SEQ ID NO: 10 and the amino acid sequence provided in SEQ ID NO: 30; and the hydroxybenzoate monooxygenase isolated from *Bacillus cereus* BGSC 6E1, having the nucleotide sequence provided in SEQ ID NO: 20 and the amino acid sequence provided in SEQ ID NO: 40.

Each of SEQ ID NOs. 21, 30, and 40 were subjected to BLAST (Basic Local Alignment Search Tool) searching to identify homologous enzymes. Homologs were selected that had an amino acid sequence having a similarity score of at least 95% identity. The similarity scores were generated using the BLAST alignment program with the BLOSUM62 substitution matrix, a gap existence penalty of 1, and a gap extension of 1. Illustrative homologs identified in this manner are provided in Table 3 below, together with their SEQ ID NOs. and the organism from which they are derived.

TABLE 3

Monooxygenase Homologs

| Enzyme | SEQ ID NO. |
|---|---|
| Homologs of Salicylate Monooxygenase (SEQ ID NO: 21): | |
| FAD-binding protein (*Bacillus anthracis* str. RIT375) | 41 |
| FAD-dependent urate hydroxylase (*Bacillus subtilis*) | 42 |
| Pyridine nucleotide-disulfide oxidoreductase family protein (*Bacillus cereus* E33L) | 43 |
| Salicylate hydroxylase (*Bacillus* sp. UMTAT18) | 44 |
| FAD binding domain protein (*Bacillus cereus* F1-15) | 45 |
| FAD-binding protein (*Bacillus cereus* str. F4429-71) | 46 |
| FAD-binding protein (*Bacillus cereus* str. MB.22) | 47 |
| FAD-binding protein (*Bacillus* sp. GZT) | 48 |

TABLE 3-continued

Monooxygenase Homologs

| Enzyme | SEQ ID NO. |
|---|---|
| Pyridine nucleotide-disulfide oxido-reductase family protein (*Bacillus thuringiensis* str. 97-27) | 49 |
| 3-hydroxybenzoate 6-hydroxylase 1 (*Streptococcus pneumonia*) | 50 |
| Homologs of Hydroxyphenylacetate Monooxygenase (SEQ ID NO: 30): | |
| 4-hydroxy-phenylacetate 3-hydroxylase (*Bacillus cereus* senso lato) | 51 |
| 4-hydroxy-phenylacetate 3-hydroxylase (*Bacillus thuringiensis*) | 52 |
| 4-hydroxy-phenylacetate 3-hydroxylase (*Bacillus cereus*) | 53 |
| 4-hydroxy-phenylacetate 3-hydroxylase (*Bacillus cereus* Rock3-42) | 54 |
| 4-hydroxy-phenylacetate 3-hydroxylase (*Bacillus cereus* SJ1) | 55 |
| 4-hydroxy-phenylacetate 3-hydroxylase (*Bacillus thuringiensis* str. CTC) | 56 |
| 4-hydroxy-phenylacetate 3-hydroxylase (*Bacillus cereus*) | 57 |
| 4-hydroxy-phenylacetate 3-hydroxylase (*Bacillus cereus* sp. GZT) | 58 |
| 4-hydroxy-phenylacetate 3-hydroxylase (*Bacillus thuringiensis*) | 59 |
| 4-hydroxy-phenylacetate 3-hydroxylase (*Bacillus cereus* str. FSL M8-0117) | 60 |
| 4-hydroxy-phenylacetate 3-hydroxylase (*Bacillus cereus* str. SDA KA 96) | 61 |
| 4-hydroxy-phenylacetate 3-hydroxylase (*Bacillus cereus* str. FSL W8-0523) | 62 |
| 4-hydroxy-phenylacetate 3-hydroxylase (*Bacillus cereus* FRI-35) | 63 |
| 4-hydroxy-phenylacetate 3-hydroxylase (*Bacillus cereus* str. FSL K6-0067) | 64 |
| 4-hydroxy-phenylacetate 3-hydroxylase (*Bacillus cereus* ATCC4342) | 65 |
| 4-hydroxy-phenylacetate 3-hydroxylase (*Bacillus cereus* AH1272) | 66 |
| 4-hydroxy-phenylacetate 3-hydroxylase (*Bacillus cereus* str. F3162-04) | 67 |
| 4-hydroxy-phenylacetate 3-hydroxylase (*Bacillus cereus* ATCC 10987) | 68 |
| 4-hydroxy-phenylacetate 3-hydroxylase (*Bacillus* sp. FK2) | 69 |
| 4-hydroxy-phenylacetate 3-hydroxylase (*Bacillus* sp. H1a) | 70 |
| Homolog of Hydroxybenzoate Monooxygenase (SEQ ID NO: 40): | |
| hydroxybenzoate monooxygenase "putative" (*Bacillus cereus*) | 71 |

The monooxygenases for use in connection with the compositions, seeds, and methods described herein can also include modified monooxygenases having one or more amino acid substitutions. For example, modified versions of the salicylate monooxygenase (SM1) from *Bacillus cereus* strain B377 (SEQ ID NO: 251) having amino acid substitutions amino acid 84 and/or amino acid 245 are provided.

The phenylalanine residue at amino acid position 84 of SEQ ID NO: 251 can be substituted with a non-aromatic amino acid.

Alternatively or in addition, the tyrosine residue at amino acid position 245 of SEQ ID NO: 251 can be substituted with a non-aromatic acid.

The non-aromatic amino acid can comprise a leucine (L), isoleucine (I), glycine (G), or valine (V). For example, the non-aromatic amino acid comprises a leucine (L) or isoleucine (I) residue.

Without being bound to any particular theory, it is thought that such amino acid substitutions allow for more efficient binding and/or increased SM1 activity or capability to degrade auxin herbicides. These monooxygenases have a modified active site that enhances the binding affinity of the monooxygenase for an auxin herbicide (e.g., dicamba).

For ease of reference, the nucleic acid sequences of suitable modified monooxygenases obtained by introducing mutations into the wild-type SM1 nucleotide sequence (SEQ ID NO: 243) are provided in Table 3A. The amino acid sequences of these monooxygenases comprising amino acid substitutions as compared to wild-type SM1 (SEQ ID NO: 251) are also provided in Table 3B. These salicylate monooxygenases have a substitution of the phenylalanine at position 84 of the wild-type SM1 enzyme (SEQ ID NO: 251) with a leucine (SM_F84L; SEQ ID NO: 252) or an isoleucine (SM_F84I; SEQ ID NO: 255) residue; a substitution of the tyrosine residue at position 245 of SEQ ID NO: 251 with a leucine (SM_Y245L; SEQ ID NO: 253) or isoleucine residue (SM_Y245I; SEQ ID NO: 256); or substitutions of both the phenylalanine at position 84 and the tyrosine at position 245 of SEQ ID NO: 251 with leucine (SM_F84L_Y245L; SEQ ID NO: 254) or isoleucine (SM_F84I_Y245I; SEQ ID NO: 257) residues.

It will readily be appreciated that enzymes having a substitution of the phenylalaine at position 84 of SEQ ID NO: 251 with a leucine residue and a substitution of the tyrosine at position 245 of SEQ ID NO: 251 with an isoleucine residue (SM_F84L_Y245I), or a substitution of the phenylalaine at position 84 of SEQ ID NO: 251 with an isoleucine residue and a substitution of the tyrosine at position 245 of SEQ ID NO: 251 with a leucine residue (SM_F84I_Y245L) are also within the scope of the present invention.

TABLE 3A

| Nucleotide sequences derived from point mutations with salicylate monooxygenase (SM1) enzyme | |
|---|---|
| Enzyme | SEQ ID NO. for nucleotide sequence |
| Salicylate monooxygenase (SM1) mutation SM_F84L (*Bacillus cereus* strain B377) | 244 |
| Salicylate monooxygenase (SM1) mutation SM_Y245L (*Bacillus cereus* strain B377) | 245 |
| Salicylate monooxygenase (SM1) mutation SM_F84L_Y245L (*Bacillus cereus* strain B377) | 246 |
| Salicylate monooxygenase (SM1) mutation SM_F84I (*Bacillus cereus* strain B377) | 247 |
| Salicylate monooxygenase (SM1) mutation SM_Y245I (*Bacillus cereus* strain B377) | 248 |
| Salicylate monooxygenase (SM1) mutation SM_F84I_Y245I (*Bacillus cereus* strain B377) | 249 |

TABLE 3B

| Amino acid sequences derived from point mutations with salicylate monooxygenase (SM1) enzyme | |
|---|---|
| Enzyme | SEQ ID NO. for amino acid sequence |
| Salicylate monooxygenase (SM1) mutation SM_ F84L (*Bacillus cereus* strain B377) | 252 |
| Salicylate monooxygenase (SM1) mutation SM_Y245L (*Bacillus cereus* strain B377) | 253 |
| Salicylate monooxygenase (SM1) mutation SM_F84L_Y245L (*Bacillus cereus* strain B377) | 254 |
| Salicylate monooxygenase (SM1) mutation SM_F84I (*Bacillus cereus* strain B377) | 255 |
| Salicylate monooxygenase (SM1) mutation SM_Y245I (*Bacillus cereus* strain B377) | 256 |
| Salicylate monooxygenase (SM1) mutation SM_F84I_Y245I (*Bacillus cereus* strain B377) | 257 |

Modified forms of the salicylate monooxygenase (SM3) from *Pseudommas putida* (SEQ ID NO: 258) having one or more amino acid substitutions are also provided. These modified enzymes have amino acid substitutions at amino acids 83 and/or 241.

The phenylalanine residue at amino acid position 83 of SEQ ID NO: 258 can be substituted with a non-aromatic amino acid.

Alternatively or in addition, the phenylalanine residue at amino acid position 241 of SEQ ID NO: 258 can be substituted with a non-aromatic acid.

The non-aromatic amino acid can comprise a leucine (L), isoleucine (I), glycine (G), or valine (V). For example, the non-aromatic amino acid comprises a leucine (L) or isoleucine (I) residue.

Without being bound by any particular theory, it is thought that such amino acid substitutions allow for more efficient binding and/or increased SM3 activity or capability to degrade auxin herbicides. These monooxygenases have a modified active site that enhances the binding affinity of the monooxygenase for an auxin herbicide (e.g., dicamba).

For ease of reference, the nucleic acid sequence of suitable modified monooxygenases obtained by introducing mutations into the wild-type SM3 nucleotide sequence (SEQ ID NO: 250) are provided in Table 3C. The amino acid sequences of these monooxygenases comprising amino acid substitutions as compared to wild-type SM1 (SEQ ID NO: 258) are also provided in Table 3D.

These salicylate monooxygenases have a substitution of the phenylalanine at position 83 of the wild-type SM3 enzyme (SEQ ID NO: 258) with a leucine (F83L; SEQ ID NO: 300) or an isoleucine (F83I; SEQ ID NO: 301) residue; a substitution of the phenylalanine residue at position 241 of SEQ ID NO: 258 with a leucine (F241L; SEQ ID NO: 302) or isoleucine residue (F241I; SEQ ID NO: 303); or substitutions of both the phenylalanine at position 83 and the phenylalanine at position 241 of SEQ ID NO: 258 with leucine (F83L_F241L; SEQ ID NO: 304) or isoleucine (F83I_F241I; SEQ ID NO: 305) residues.

It will readily be appreciated that enzymes having a substitution of the phenylalaine at position 83 of SEQ ID NO: 258 with a leucine residue and a substitution of the phenylalaine at position 241 of SEQ ID NO: 258 with an isoleucine residue (F83L_F241I), or a substitution of the phenylalaine at position 83 of SEQ ID NO: 258 with an isoleucine residue and a substitution of the phenylalaine at position 241 of SEQ ID NO: 258 with a leucine residue (F83I_F241L) are also within the scope of the present invention.

TABLE 3C

| Nucleotide sequences derived from point mutations with salicylate monooxygenase (SM3) enzyme | |
|---|---|
| Enzyme | SEQ ID NO. for nucleotide sequence |
| Salicylate monooxygenase (SM3) mutation: F83L (*Pseudommas putida*) | 294 |
| Salicylate monooxygenase (SM3) mutation: F83I (*Pseudommas putida*) | 295 |
| Salicylate monooxygenase (SM3) mutation: F241L (*Pseudommas putida*) | 296 |
| Salicylate monooxygenase (SM3) mutation: F241I (*Pseudommas putida*) | 297 |
| Salicylate monooxygenase (SM3) mutation: F83L-F241L (*Pseudommas putida*) | 298 |
| Salicylate monooxygenase (SM3) mutation: F83I-F241I (*Pseudommas putida*) | 299 |

TABLE 3D

| Amino acid sequences derived from point mutations with salicylate monooxygenase (SM3) enzyme | |
|---|---|
| Enzyme | SEQ ID NO. for amino acid sequence |
| Salicylate monooxygenase (SM3) mutation: F83L (*Pseudommas putida*) | 300 |
| Salicylate monooxygenase (SM3) mutation: F83I (*Pseudommas putida*) | 301 |
| Salicylate monooxygenase (SM3) mutation: F241L (*Pseudommas putida*) | 302 |
| Salicylate monooxygenase (SM3) mutation: F241I (*Pseudommas putida*) | 303 |
| Salicylate monooxygenase (SM3) mutation: F83L_F241L (*Pseudommas putida*) | 304 |
| Salicylate monooxygenase (SM3) mutation: F83I_F241I (*Pseudommas putida*) | 305 |

B. Phenolic Acid Decarboxylases

Decarboxylases remove carboxyl groups ($CO_2H$) from acidic substrates and some require either pyridoxal phosphate or pyruvate as a co-factor. Decarboxylases are known for their various roles in metabolic pathways and carbohydrate synthesis. The decarboxylases for use in the present invention are suitably: (1) any of a group of enzymes that accelerate decarboxylation, especially of amino acids, (2) any of the class of enzymes that catalyze the release of carbon dioxide from the carboxyl group of certain organic acids, or (3) any of the class of enzymes that catalyze the release of carbon dioxide and the indicated products from acidic substrates, requiring pyridoxal phosphate or pyruvic acid as a co-factor.

Phenolic acid decarboxylases are capable of removing a carboxyl group(s) from a phenolic acid compound or phenolic acid derivative and releasing carbon dioxide ($CO_2$). The phenolic acid decarboxylases suitable for use in connection with the compositions, seeds, and methods described herein can detoxify an auxin herbicide and/or degrade an auxin plant growth regulator (e.g., dicamba or 2,4-D), or a metabolic product thereof. The various bi-products of such detoxifying reactions can include, but are not limited to, 2,5-dichlor anisole, 4-chloro-3-methoxy phenol and 2,5-dichloro phenol.

The Enzyme Commission (EC) number for phenolic acid decarboxylases is 4.11.

A sample reaction scheme for degradation of a carboxylated phenolic acid by a phenolic acid decarboxylases is shown below:

$$4\text{benzenediol}+O_2 \rightarrow 4\text{benzosemiquinone}+2H_2O.$$

The reduction of oxygen to water is accompanied by the oxidation reaction with a phenolic substrate.

For ease of reference, the nucleic acid sequence for the phenolic acid decarboxylase identified through screening of the microbial library is provided in Table 4 below, together with the bacterial strain from which it was derived and its SEQ ID NO. The amino acid sequence for these phenolic acid decarboxylase is provided in Table 5 below.

TABLE 4

Nucleotide sequence for phenolic acid decarboxylase.

| Enzyme | SEQ ID NO. for nucleotide sequence |
|---|---|
| Phenolic acid decarboxylase (*Bacillus mycoides* B55) | 72 |

TABLE 5

Amino Acid sequence for Phenolic Acid Decarboxylase

| Enzyme | SEQ ID NO. for amino acid sequence |
|---|---|
| Phenolic acid decarboxylase B55 (*Bacillus mycoides*) | 73 |

C. Chlorohydrolases

Chlorohydrolases remove one or more halogen groups from an aromatic ring by hydrolyzing carbon-chlorine bonds. The chlorohydrolases for use in connection with the compositions, seeds, and methods described herein are capable of removing halogen groups from aromatic rings of auxin herbicides. Removal of the halogen groups from auxin herbicides renders them less effective and subject to enhanced biodegradation.

For ease of reference, the nucleic acid sequences for the chlorohydrolases identified through screening of the microbial library are provided in Table 6 below, together with the bacterial strain from which each chlorohydrolase was derived and their SEQ ID NO. The amino acid sequences for each of these chlorohydrolases are provided in Table 7 below. Table 7 also provides the sequence for a chlorohydrolase of SEQ ID NO: 168, wherein the first fifteen amino acids of the sequence have been truncated (SEQ ID NO: 169).

TABLE 6

Nucleotide sequences for chlorohydrolases

| Enzyme | SEQ ID NO. for nucleotide sequence |
|---|---|
| Hydrolase (*Bacillus cereus* strain ATCC 10987) | 74 |
| Hydrolase (*Bacillus cereus* strain B06.009) [homolog SEQ ID NO: 145] | 75 |
| Chlorohydrolase family protein (*Bacillus cereus* strain ATCC 10987) | 76 |
| 5-methylthioadenosine deaminase (*Bacillus cereus* strain FSL K6-0040) | 77 |
| 5methylthioadenosine/Sadenosylhomo-cysteine deaminase (*Bacillus cereus* strain AH1271) | 78 |
| Chlorohydrolase family protein (*Bacillus cereus* strain G9842) | 79 |
| 5-methylthioadenosine/Sadenosylhomo-cysteine deaminase (*Bacillus cereus* strain BAG30-1) | 80 |
| 5-methylthioadenosine deaminase (*Bacillus cereus* strain FSL P4-0569) | 81 |
| 5-methylthioadenosine/Sadenosylhomo-cysteine deaminase (*Bacillus cereus* BAG5X2-1) | 82 |

TABLE 6-continued

Nucleotide sequences for chlorohydrolases

| Enzyme | SEQ ID NO. for nucleotide sequence |
|---|---|
| S-adenosylhomo-cysteine deaminase (*Bacillus cereus* strain B4077) | 83 |
| 5-methylthioadenosine/S-adenosylhomo-cysteine deaminase (*Bacillus cereus* strain MM3) | 84 |
| S-adenosylhomo-cysteine deaminase Methylthioadenosine deaminase (*Bacillus cereus* strain B4088) | 85 |
| 5-methylthioadenosine deaminase (*Bacillus mycoides* strain PE8-15) | 86 |
| 5-methylthioadenosine/S-adenosylhomo-cysteine deaminase (*Bacillus weihenstephanensis* strain FSL H7-687) | 87 |
| 5-methylthioadenosine deaminase (*Bacillus cereus* strain FSL K6-0069) | 88 |
| 5-methylthioadenosine/S-adenosylhomo-cysteine deaminase (*Bacillus thuringiensis* serovar *tochigiensis* strain BGSC 4Y1) | 89 |
| Amidohydrolase family protein (*Bacillus mycoides* strain ATCC 6462) | 90 |
| Amidohydrolase family protein (*Bacillus cereus* strain S612) | 91 |
| S-adenosylhomo-cysteine deaminase (*Bacillus mycoides* strain B38V) | 92 |
| 5-methylthioadenosine/5-adenosylhomoxy-steine deaminase (*Bacillus thuringiensis* strain HD-771) | 93 |
| 5-methylthioadenosine deaminase (*Bacillus cereus* strain FSL M7-1251) | 94 |
| 5-methylthioadenosine deaminase (*Bacillus cereus* strain CTC) | 95 |
| 5-methylthioadenosine/S-adenosylhomo-cysteine deaminase *Bacillus cereus* strain VD078 | 96 |
| 5-methylthioadenosine/S-adenosylhomo-cysteine deaminase *Bacillus thuringiensis* serovar *sotto* strain T04001 | 97 |
| Chlorohydrolase (*Streptococcus pneumoniae*) | 98 |
| 5-methylthioadenosine/S-adenosylhomo-cysteine deaminase (*Bacillus cereus* strain HuA2-9) | 99 |
| 5-methylthioadenosine/S-adenosylhomo-cysteine deaminase (*Bacillus cereus* strain VDM062) | 100 |
| 5-methylthioadenosine/S-adenosylhomo-cysteine deaminase (*Bacillus cereus* strain VD014) | 101 |
| Chlorohydrolase family protein (*Bacillus cereus* strain H3081.97) | 102 |
| 5-methylthioadenosine deaminase (*Bacillus cereus* strain FSL W8-0523) | 103 |
| 5-methylthioadenosine/S-adenosylhomo-cysteine deaminase (*Bacillus cereus* strain Rock4-18) | 104 |
| Amidohydrolase family protein (*Bacillus cereus* strain G9241) | 105 |
| 5-methylthioadenosine deaminase (*Bacillus* species strain Roo131) | 106 |
| Amidohydrolase family protein (*Bacillus thuringiensis* strain HD1002) | 107 |
| Amidohydrolase family protein (*Bacillus cereus* strain F1-15 DJ87) | 108 |
| Chlorohydrolase family protein (*Bacillus cereus* strain AH1134) | 109 |
| Chlorohydrolase family protein (*Bacillus cereus* strain AH187) | 110 |
| Aminohydrolase family protein (*Bacillus cereus* strain ATCC 4342) | 111 |
| Chlorohydrolase (*Bacillus* species UMTAT18) | 112 |
| Amidohydrolase family protein (*Bacillus cereus* strain 13061) | 113 |
| Chlorohydrolase (*Streptococcus pneumoniae*) | 114 |
| 6-chloronicotinic acid chlorohydrolase (Bradyrhizohiaceae strain SG-6C) | 115 |
| Chlorothalonil dehalogenase (*Pseudomonas* species strain CTN-3) | 116 |
| Chlorothalonil dehalogenase (Chd) (*Paracoccus* species XF-3) | 117 |
| Chlorothalonil dehalogenase (Chd-b) (*Rhodococcus* species strain XF-8) | 118 |

TABLE 6-continued

Nucleotide sequences for chlorohydrolases

| Enzyme | SEQ ID NO. for nucleotide sequence |
|---|---|
| Chlorothalonil hydrolytic dehalogenase (*Rhizobium* species strain CTN-15) | 119 |
| Hydrolytic dehalogenase (*Ochrobactrum lupine*) | 120 |
| Chlorothalonil hydrolytic dehalogenase (*Bordetella* species strain CTN-10) | 121 |
| Chlorothalonil hydrolytic dehalogenase (*Shinella* species strain CTN-13) | 122 |
| Chlorothalonil hydrolytic dehalogenase (*Ochrobactrum* species strain CTN-11) | 123 |
| Chlorothalonil hydrolytic dehalogenase (*Lysobacter ruishenii*) | 124 |
| Chlorothalonil hydrolytic dehalogenase (*Caulobacter* species CTN-14) | 125 |

TABLE 7

Amino acid sequences for chlorohydrolases

| Enzyme | SEQ ID NO. for amino acid sequence |
|---|---|
| Hydrolase (*Bacillus cereus* strain ATCC 10987) | 126 |
| Hydrolase (*Bacillus cereus* strain B06.009) | 127 |
| Chlorohydrolase family protein (*Bacillus cereus* strain ATCC 10987) | 128 |
| 5-methylthioadenosine deaminase (*Bacillus cereus* strain FSL K6-0040) | 129 |
| 5methylthioadenosine/Sadenosylhomo-cysteine deaminase (*Bacillus cereus* strain AH1271) | 130 |
| Chlorohydrolase family protein (*Bacillus cereus* strain G9842) | 131 |
| 5-methylthioadenosine/Sadenosylhomo-cysteine deaminase (*Bacillus cereus* strain BAG30-1) | 132 |
| 5-methylthioadenosine deaminase (*Bacillus cereus* strain FSL P4-0569) | 133 |
| 5-methylthioadenosine/S-adenosylhomo-cysteine deaminase (*Bacillus cereus* BAG5X2-1) | 134 |
| S-adenosylhomo-cysteine deaminase (*Bacillus cereus* strain B4077) | 135 |
| 5-methylthioadenosine/S-adenosylhomo-cysteine deaminase (*Bacillus cereus* strain MM3) | 136 |
| S-adenosylhomo-cysteine deaminase Methylthioadenosine deaminase (*Bacillus cereus* strain B4088) | 137 |
| 5-methylthioadenosine deaminase (*Bacillus mycoides* strain PE8-15) | 138 |
| 5-methylthioadenosine/S-adenosylhomo-cysteine deaminase (*Bacillus weihenstephanensis* strain FSL H7-687) | 139 |
| 5-methylthioadenosine deaminase (*Bacillus cereus* strain FSL K6-0069) | 140 |
| 5-methylthioadenosine/S-adenosylhomo-cysteine deaminase (*Bacillus thuringiensis* serovar tochigiensis strain BGSC 4Y1) | 141 |
| Amidohydrolase family protein (*Bacillus mycoides* strain ATCC 6462) | 142 |
| Amidohydrolase family protein (*Bacillus cereus* strain S612) | 143 |
| S-adenosylhomo-cysteine deaminase (*Bacillus mycoides* strain B38V) | 144 |
| 5-methylthioadenosine/5-adenosylhomoxy-steine deaminase (*Bacillus thuringiensis* strain HD-771) | 145 |
| 5-methylthioadenosine deaminase (*Bacillus cereus* strain FSL M7-1251) | 146 |
| 5-methylthioadenosine deaminase (*Bacillus cereus* strain CTC) | 147 |
| 5-methylthioadenosine/S-adenosylhomo-cysteine deaminase (*Bacillus cereus* strain VD078) | 148 |
| 5-methylthioadenosine/S-adenosylhomo-cysteine deaminase (*Bacillus thuringiensis* serovar sotto strain T04001) | 149 |
| Chlorohydrolase (*Streptococcus pneumoniae*) | 150 |
| 5-methylthioadenosine/S-adenosylhomo-cysteine deaminase (*Bacillus cereus* strain HuA2-9) | 151 |
| 5-methylthioadenosine/S-adenosylhomo-cysteine deaminase (*Bacillus cereus* strain VDM062) | 152 |
| 5-methylthioadenosine/S-adenosylhomo-cysteine deaminase (*Bacillus cereus* strain VD014) | 153 |
| Chlorohydrolase family protein (*Bacillus cereus* strain H3081.97) | 154 |
| 5-methylthioadenosine deaminase (*Bacillus cereus* strain FSL W8-0523) | 155 |
| 5-methylthioadenosine/S-adenosylhomo-cysteine deaminase (*Bacillus cereus* strain Rock4-18) | 156 |
| Amidohydrolase family protein (*Bacillus cereus* strain G9241) | 157 |
| 5-methylthioadenosine deaminase (*Bacillus* species strain Roo131) | 158 |
| Amidohydrolase family protein (*Bacillus thuringiensis* strain HD1002) | 159 |
| Amidohydrolase family protein (*Bacillus cereus* strain F1-15 DJ87) | 160 |
| Chlorohydrolase family protein (*Bacillus cereus* strain AH1134) | 161 |
| Chlorohydrolase family protein (*Bacillus cereus* strain AH187) | 162 |
| Aminohydrolase family protein (*Bacillus cereus* strain ATCC 4342) | 163 |
| Chlorohydrolase (*Bacillus* species UMTAT18) | 164 |
| Amidohydrolase family protein (*Bacillus cereus* strain 13061) | 165 |
| Chlorohydrolase (*Streptococcus pneumoniae*) | 166 |
| 6-chloronicotinic acid chlorohydrolase (*Bradyrhizobiaceae* strain SG-6C) | 167 |
| Chlorothalonil dehalogenase (*Pseudomonas* species strain CTN-3) | 168 |
| Chlorothalonil dehalogenase (*Pseudomonas* species strain CTN-3, with 15-amino acid N-terminal truncation) | 169 |
| Chlorothalonil dehalogenase (Chd) (*Paracoccus* species XF-3) | 170 |
| Chlorothalonil dehalogenase (Chd-b) (*Rhodococcus* species strain XF-8) | 171 |
| Chlorothalonil hydrolytic dehalogenase (*Rhizobium* species strain CTN-15) | 172 |
| Hydrolytic dehalogenase (*Ochrobactrum lupine*) | 173 |
| Chlorothalonil hydrolytic dehalogenase (*Bordetella* species strain CTN-10) | 174 |
| Chlorothalonil hydrolytic dehalogenase (*Shinella* species strain CTN-13) | 175 |
| Chlorothalonil hydrolytic dehalogenase (*Ochrobactrum* species strain CTN-11) | 176 |
| Chlorothalonil hydrolytic dehalogenase (*Lysobacter ruishenii*) | 177 |
| Chlorothalonil hydrolytic dehalogenase (*Caulobacter* species CTN-14) | 178 |

Preferred chlorohydrolases include the 6-chloronicotinic acid chlorohydrolase (CAC) derived from *Bradyrhizobiaceae* strain SG-6C, having the nucleotide sequence provided in SEQ ID NO: 115 and the amino acid sequence provided in SEQ ID NO: 167 and the chlorothalonil dehalogenase (ChD) derived from *Pseudomonas* species strain CTN-3, having the having the nucleotide sequence provided in SEQ ID NO: 116 and the amino acid sequence provided in SEQ ID NO: 168; as well as the chlorothalonil dehalogenase (ChD) derived from *Pseudomonas* species strain CTN-3 having a fifteen amino acid truncation at its N-terminus, having the amino acid sequence provided in SEQ ID NO: 169.

Without being bound to any particular theory, it is thought that at least some of the chlorohydrolases described herein exert their detoxifying effects primarily by sequestering the herbicide such that it cannot be taken up by the plant. For example, it is thought that at least some of the chlorohydrolases exert their detoxifying effects on dicamba by tightly binding to dicamba and holding it in the active site of the enzyme, thereby preventing the dicamba from being taken up by a plant.

D. Dioxygenases and Hydroxylases

Other enzymes useful for the degradation of chlorophenoxy herbicides are provided. These enzymes include alpha ketoglutarate dependent dioxygenases and chlorophenol hydroxylases that are used in a two step process to degrade chlorophenoxy herbicides (e.g., 2, 4 D). The chlorophenol hydroxylase can comprise a dichlorophenol hydroxylase. For example, useful enzymes for degrading 2,4-D can include 2,4-D alpha-ketoglutarate dioxygenases (TfdAs) and 2,4-dichlorophenol hydroxylases (TfdBs). These enzymes degrade 2,4-D in the following two step process:

TfdA:2,4-D/MCPA+α-KG+$O_2$ 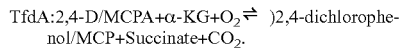 )2,4-dichlorophenol/MCP+Succinate+$CO_2$.

TfdB:2,4-dichlorophenol+NADPH+$H^+$+$O_2$ 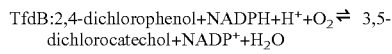 3,5-dichlorocatechol+$NADP^+$+$H_2O$ Ring-cleaving dioxygenases (e.g., MhqA) can also be used to degrade chlorophenoxy herbicides.

For ease of reference, nucleic acid sequences for illustrative dioxygenases (e.g., alpha-ketoglutarate dependent dioxygenases and ring-cleaving dioxygenases) and hydroxylases (e.g., dichlorophenol hydroxylases) are provided in Tables 7A and 7C below. The amino acid sequences for each of these dioxygenases and hydroxylases are provided in Tables 7B and 7D, respectively. Tables 7A and 7B also provide the nucleotide and amino acid sequences for a dioxygenase of SEQ ID NO: 276, having an A198V mutation that increases activity against chlorophenoxy herbicides (SEQ ID NO: 274 (nucleotide) and SEQ ID NO: 277 (amino acid)).

TABLE 7A

Chlorophenoxy degrading enzymes - Dioxygenases:
Nucleic Acid Sequences

| Enzyme | SEQ ID NO. for nucleotide sequence |
|---|---|
| 2,4-D-alpha ketoglutarate dioxygenase (Tfda) (*Bacillus aryabhattai*) | 273 |
| 2,4-D-alpha ketoglutarate dioxygenase (Tfda) (Mutation A198V) (*Bacillus aryabhattai*) | 274 |
| alpha-ketoglutarate-dependent 2,4-dichlorophenoxyacetate dioxygenase (Burkholderiaceae) | 275 |
| MhqA Ring Cleaving Dioxygenase (*Bacillus subtilis* strain 168) | 283 |

TABLE 7B

Chlorophenoxy degrading enzymes -
Dioxygenases: Amino Acid Sequences

| Enzyme | SEQ ID NO. for amino acid sequence |
|---|---|
| 2,4-D-alpha ketoglutarate dioxygenase (Tfda) (*Bacillus aryabhattai*) | 276 |
| 2,4-D-alpha ketoglutarate dioxygenase (Tfda) (Mutation A198V) (*Bacillus aryabhattai*) | 277 |

TABLE 7B-continued

Chlorophenoxy degrading enzymes -
Dioxygenases: Amino Acid Sequences

| Enzyme | SEQ ID NO. for amino acid sequence |
|---|---|
| alpha-ketoglutarate-dependent 2,4-dichlorophenoxyacetate dioxygenase (Burkholderiaceae) | 278 |
| MhqA Ring Cleaving Dioxygenase (*Bacillus subtilis* strain 168) | 284 |

TABLE 7C

Chlorophenoxy degrading enzyme - Hydroxylase:
Nucleic Acid Sequence

| Enzyme | SEQ ID NO. for nucleotide sequence |
|---|---|
| dichlorophenol hydroxylase (TfdB) (*Ralstonia eutropha*) | 279 |

TABLE 7D

Chlorophenoxy degrading enzymes -
Hydroxylases: Amino Acid sequences

| Enzyme | SEQ ID NO. for amino acid sequence |
|---|---|
| dichlorophenol hydroxylase (TfdB) (*Ralstonia eutropha*) | 281 |

Tables 7A and 7B provide the nucleotide and amino acid sequences for an illustrative ring cleaving dioxygenase (MhqA) (SEQ ID NOs. 283 and 284). This MhqA enzyme or other ring-cleaving dioxygenases can be used in any of the compositions, seeds or methods described herein to act on chloroquinone compounds and chlorophenoxy herbicides as a direct donor of electrons for dechlorination reactions and functions in the degradation of aromatic compounds in the presence of ion ($Fe^{2+}$) as a cofactor. Illustrative chlorophenoxy herbicides that can be degraded using a ring cleaving dioxygenase such as MhqA are listed in table 7E below.

TABLE 7E

Chlorophenoxy herbicides for dechlorination
by ring cleavage dioxygenase

| Common Name | Trade Names | Chemical Name |
|---|---|---|
| 2,4-D | WEEDAR (amine) WEEDONE (ester) | 2,4-dichlorophenoxyacetic acid |
| 2,4-DB | BUTOXONE BUTYRAC | 4-(2,4-dichlorophenoxy)butyric acid |
| MCPA | Agritox Agroxone Chiptox Rhonox Weed-Rhap | 2-methyl-4-chlorophenoxyacetic acid |

TABLE 7E-continued

Chlorophenoxy herbicides for dechlorination by ring cleavage dioxygenase

| Common Name | Trade Names | Chemical Name |
|---|---|---|
| MCPP (Mecoprop) | Kilprop Mecopar Mecomin-D Triester-11 | Potassium (RS)-2-(2-methyl-4-chlorophenoxy)propionate |
| Dicamba | CLASH Banvel Diablo Oracle Vanguish | 3,6-dichloro-2-methoxybenzoic acid |

D. Nucleic Acids, Vectors, Host Cells

An isolated nucleic acid is provided. The isolated nucleic acid can comprise a nucleic acid sequence having at least 70% identity to any one of SEQ ID NOs. 72, 115, 250, 266, 267, and 294-299.

The isolated nucleic acid can comprise a nucleic acid sequence having at least 75% identity to any one of SEQ ID NOs. 72, 115, 250, 266, 267, and 294-299.

The isolated nucleic acid can comprise a nucleic acid sequence having at least 80% identity to any one of SEQ ID NOs. 72, 115, 250, 266, 267, and 294-299.

The isolated nucleic acid can comprise a nucleic acid sequence having at least 85% identity to any one of SEQ ID NOs. 72, 115, 250, 266, 267, and 294-299.

The isolated nucleic acid can comprise a nucleic acid sequence having at least 90% identity to any one of SEQ ID NOs. 72, 115, 250, 266, 267, and 294-299.

The isolated nucleic acid can comprise a nucleic acid sequence having at least 95% identity to any one of SEQ ID NOs. 72, 115, 250, 266, 267, and 294-299.

The isolated nucleic acid can comprise a nucleic acid sequence having at least 98% identity to any one of SEQ ID NOs. 72, 115, 250, 266, 267, and 294-299.

The isolated nucleic acid can comprise a nucleic acid sequence having at least 99% identity to any one of SEQ ID NOs. 72, 115, 250, 266, 267, and 294-299.

The isolated nucleic acid can comprise a nucleic acid sequence having 100% identity to any one of SEQ ID NOs. 72, 115, 250, 266, 267, and 294-299.

A further isolated nucleic acid is provided. The isolated nucleic acid can comprise a nucleic acid sequence having at least 90% identity to SEQ ID NO: 19 or 20.

The isolated nucleic acid can comprise a nucleic acid sequence having at least 95% identity to SEQ ID NO: 19 or 20.

The isolated nucleic acid can comprise a nucleic acid sequence having at least 98% identity to SEQ ID NO: 19 or 20.

The isolated nucleic acid can comprise a nucleic acid sequence having at least 99% identity to SEQ ID NO: 19 or 20.

The isolated nucleic acid can comprise a nucleic acid sequence having 100% identity to SEQ ID NO: 19 or 20.

Another isolated nucleic acid is provided. The isolated nucleic acid can comprise a nucleic acid sequence having at least 93% identity to SEQ ID NO: 16 or 17.

The isolated nucleic acid can comprise a nucleic acid sequence having at least 95% identity to SEQ ID NO: 16 or 17.

The isolated nucleic acid can comprise a nucleic acid sequence having at least 98% identity to SEQ ID NO: 16 or 17.

The isolated nucleic acid can comprise a nucleic acid sequence having at least 99% identity to SEQ ID NO: 16 or 17.

The isolated nucleic acid can comprise a nucleic acid sequence having 100% identity to SEQ ID NO: 16 or 17.

Yet another isolated nucleic acid is provided. The isolated nucleic acid can comprise a nucleic acid sequence having at least 94% identity to SEQ ID NO: 15 or 18.

The isolated nucleic acid can comprise a nucleic acid sequence having at least 95% identity to SEQ ID NO: 15 or 18.

The isolated nucleic acid can comprise a nucleic acid sequence having at least 98% identity to SEQ ID NO: 15 or 18.

The isolated nucleic acid can comprise a nucleic acid sequence having at least 99% identity to SEQ ID NO: 15 or 18.

The isolated nucleic acid can comprise a nucleic acid sequence having 100% identity to SEQ ID NO: 15 or 18.

A further isolated nucleic acid is provided. The isolated nucleic acid can comprise a nucleic acid sequence having at least 96% identity to SEQ ID NO: 13.

The isolated nucleic acid can comprise a nucleic acid sequence having at least 98% identity to SEQ ID NO: 13.

The isolated nucleic acid can comprise a nucleic acid sequence having at least 99% identity to SEQ ID NO: 13.

The isolated nucleic acid can comprise a nucleic acid sequence having 100% identity to SEQ ID NO: 13.

Another isolated nucleic acid is provided. The isolated nucleic acid can comprise a nucleic acid sequence having at least 97% identity to any one of SEQ ID NOs. 81, 82, 91, 94, and 101.

The isolated nucleic acid can comprise a nucleic acid sequence having at least 98% identity to any one of SEQ ID NOs. 81, 82, 91, 94, and 101.

The isolated nucleic acid can comprise a nucleic acid sequence having at least 99% identity to any one of SEQ ID NOs. 81, 82, 91, 94, and 101.

The isolated nucleic acid can comprise a nucleic acid sequence having 100% identity to any one of SEQ ID NOs. 81, 82, 91, 94, and 101.

Yet another isolated nucleic acid is provided. The isolated nucleic acid can comprise a nucleic acid sequence having at least 98% identity to any one of SEQ ID NOs. 77, 78, 80, and 85.

The isolated nucleic acid can comprise a nucleic acid sequence having at least 99% identity to any one of SEQ ID NOs. 77, 78, 80, and 85.

The isolated nucleic acid can comprise a nucleic acid sequence having 100% identity to any one of SEQ ID NOs. 77, 78, 80, and 85.

A further isolated nucleic acid is provided. The isolated nucleic acid can comprise a nucleic acid sequence having at least 99% identity to any one of SEQ ID NOs. 7, 11, 88, 98, 102, 103, 113, and 260.

The isolated nucleic acid can comprise a nucleic acid sequence having 100% identity to any one of SEQ ID NOs. 7, 11, 88, 98, 102, 103, 113 and 260.

Another isolated nucleic acid is provided. The isolated nucleic acid can comprise a nucleic acid sequence having at least 78% identity to SEQ ID NO: 273.

The isolated nucleic acid can comprise a nucleic acid sequence having at least 80% identity to SEQ ID NO: 273.

The isolated nucleic acid can comprise a nucleic acid sequence having at least 85% identity to SEQ ID NO: 273.

The isolated nucleic acid can comprise a nucleic acid sequence having at least 90% identity to SEQ ID NO: 273.

The isolated nucleic acid can comprise a nucleic acid sequence having at least 95% identity to SEQ ID NO: 273.

The isolated nucleic acid can comprise a nucleic acid sequence having at least 98% identity to SEQ ID NO: 273.

The isolated nucleic acid can comprise a nucleic acid sequence having at least 99% identity to SEQ ID NO: 273.

The isolated nucleic acid can comprise a nucleic acid sequence having 100% identity to SEQ ID NO: 273.

The isolated nucleic acid can comprise a nucleic acid sequence having at least 70% identity to SEQ ID NO. 273, wherein codon 198 is replaced with a codon that codes for a valine residue.

The isolated nucleic acid can comprise a nucleic acid sequence having at least 75% identity to SEQ ID NO. 273, wherein codon 198 is replaced with a codon that codes for a valine residue.

The isolated nucleic acid can comprise a nucleic acid sequence having at least 80% identity to SEQ ID NO. 273, wherein codon 198 is replaced with a codon that codes for a valine residue.

The isolated nucleic acid can comprise a nucleic acid sequence having at least 85% identity to SEQ ID NO. 273, wherein codon 198 is replaced with a codon that codes for a valine residue.

The isolated nucleic acid can comprise a nucleic acid sequence having at least 90% identity to SEQ ID NO. 273, wherein codon 198 is replaced with a codon that codes for a valine residue.

The isolated nucleic acid can comprise a nucleic acid sequence having at least 95% identity to SEQ ID NO. 273, wherein codon 198 is replaced with a codon that codes for a valine residue.

The isolated nucleic acid can comprise a nucleic acid sequence having at least 98% identity to SEQ ID NO. 273, wherein codon 198 is replaced with a codon that codes for a valine residue.

The isolated nucleic acid can comprise a nucleic acid sequence having at least 99% identity to SEQ ID NO. 273, wherein codon 198 is replaced with a codon that codes for a valine residue.

The isolated nucleic acid can comprise a nucleic acid sequence having at least 78% identity to SEQ ID NO. 274, wherein codon 198 is replaced with a codon that codes for a valine residue.

The isolated nucleic acid can comprise a nucleic acid sequence having at least 80% identity to SEQ ID NO. 274, wherein codon 198 is replaced with a codon that codes for a valine residue.

The isolated nucleic acid can comprise a nucleic acid sequence having at least 85% identity to SEQ ID NO. 274, wherein codon 198 is replaced with a codon that codes for a valine residue.

The isolated nucleic acid can comprise a nucleic acid sequence having at least 90% identity to SEQ ID NO. 274, wherein codon 198 is replaced with a codon that codes for a valine residue.

The isolated nucleic acid can comprise a nucleic acid sequence having at least 95% identity to SEQ ID NO. 274, wherein codon 198 is replaced with a codon that codes for a valine residue.

The isolated nucleic acid can comprise a nucleic acid sequence having at least 98% identity to SEQ ID NO. 274, wherein codon 198 is replaced with a codon that codes for a valine residue.

The isolated nucleic acid can comprise a nucleic acid sequence having at least 99% identity to SEQ ID NO. 274, wherein codon 198 is replaced with a codon that codes for a valine residue.

The isolated nucleic acid can comprise a nucleic acid sequence having 100% identity to SEQ ID NO. 274, wherein codon 198 is replaced with a codon that codes for a valine residue.

The isolated nucleic acid can comprise a nucleic acid sequence having at least 97.5% sequence identity to SEQ ID NO: 243.

The isolated nucleic acid can comprise a nucleic acid sequence having at least 98% sequence identity to SEQ ID NO: 243.

The isolated nucleic acid can comprise a nucleic acid sequence having at least 99% sequence identity to SEQ ID NO: 243.

The isolated nucleic acid can comprise a nucleic acid sequence having 100% sequence identity to SEQ ID NO: 243.

Another isolated nucleic acid is provided. The isolated nucleic acid can comprise a nucleic acid sequence having at least 70% sequence identity to SEQ ID NO: 243, wherein codon 84 is replaced with a codon that codes for a non-aromatic amino acid.

The isolated nucleic acid can comprise a nucleic acid sequence having at least 75% sequence identity to SEQ ID NO: 243, wherein codon 84 is replaced with a codon that codes for a non-aromatic amino acid.

The isolated nucleic acid can comprise a nucleic acid sequence having at least 80% sequence identity to SEQ ID NO: 243, wherein codon 84 is replaced with a codon that codes for a non-aromatic amino acid.

The isolated nucleic acid can comprise a nucleic acid sequence having at least 85% sequence identity to SEQ ID NO: 243, wherein codon 84 is replaced with a codon that codes for a non-aromatic amino acid.

The isolated nucleic acid can comprise a nucleic acid sequence having at least 90% sequence identity to SEQ ID NO: 243, wherein codon 84 is replaced with a codon that codes for a non-aromatic amino acid.

The isolated nucleic acid can comprise a nucleic acid sequence having at least 95% sequence identity to SEQ ID NO: 243, wherein codon 84 is replaced with a codon that codes for a non-aromatic amino acid.

The isolated nucleic acid can comprise a nucleic acid sequence having at least 98% sequence identity to SEQ ID NO: 243, wherein codon 84 is replaced with a codon that codes for a non-aromatic amino acid.

The isolated nucleic acid can comprise a nucleic acid sequence having at least 99% sequence identity to SEQ ID NO: 243, wherein codon 84 is replaced with a codon that codes for a non-aromatic amino acid.

The isolated nucleic acid can comprise a nucleic acid sequence having at least 70% sequence identity to SEQ ID NO: 243, wherein codon 245 is replaced with a codon that codes for a non-aromatic amino acid.

The isolated nucleic acid can comprise a nucleic acid sequence having at least 75% sequence identity to SEQ ID NO: 243, wherein codon 245 is replaced with a codon that codes for a non-aromatic amino acid.

The isolated nucleic acid can comprise a nucleic acid sequence having at least 80% sequence identity to SEQ ID NO: 243, wherein codon 245 is replaced with a codon that codes for a non-aromatic amino acid.

The isolated nucleic acid can comprise a nucleic acid sequence having at least 85% sequence identity to SEQ ID NO: 243, wherein codon 245 is replaced with a codon that codes for a non-aromatic amino acid.

The isolated nucleic acid can comprise a nucleic acid sequence having at least 90% sequence identity to SEQ ID NO: 243, wherein codon 245 is replaced with a codon that codes for a non-aromatic amino acid.

The isolated nucleic acid can comprise a nucleic acid sequence having at least 95% sequence identity to SEQ ID NO: 243, wherein codon 245 is replaced with a codon that codes for a non-aromatic amino acid.

The isolated nucleic acid can comprise a nucleic acid sequence having at least 98% sequence identity to SEQ ID NO: 243, wherein codon 245 is replaced with a codon that codes for a non-aromatic amino acid.

The isolated nucleic acid can comprise a nucleic acid sequence having at least 99% sequence identity to SEQ ID NO: 243, wherein codon 245 is replaced with a codon that codes for a non-aromatic amino acid.

The isolated nucleic acid can comprise a nucleic acid sequence having at least 70% sequence identity to SEQ ID NO: 243, wherein both codons 84 and 245 are replaced with codons that code for a non-aromatic amino acid.

The isolated nucleic acid can comprise a nucleic acid sequence having at least 75% sequence identity to SEQ ID NO: 243, wherein both codons 84 and 245 are replaced with codons that code for a non-aromatic amino acid.

The isolated nucleic acid can comprise a nucleic acid sequence having at least 80% sequence identity to SEQ ID NO: 243, wherein both codons 84 and 245 are replaced with codons that code for a non-aromatic amino acid.

The isolated nucleic acid can comprise a nucleic acid sequence having at least 85% sequence identity to SEQ ID NO: 243, wherein both codons 84 and 245 are replaced with codons that code for a non-aromatic amino acid.

The isolated nucleic acid can comprise a nucleic acid sequence having at least 90% sequence identity to SEQ ID NO: 243, wherein both codons 84 and 245 are replaced with codons that code for a non-aromatic amino acid.

The isolated nucleic acid can comprise a nucleic acid sequence having at least 95% sequence identity to SEQ ID NO: 243, wherein both codons 84 and 245 are replaced with codons that code for a non-aromatic amino acid.

The isolated nucleic acid can comprise a nucleic acid sequence having at least 98% sequence identity to SEQ ID NO: 243, wherein both codons 84 and 245 are replaced with codons that code for a non-aromatic amino acid.

The isolated nucleic acid can comprise a nucleic acid sequence having at least 99% sequence identity to SEQ ID NO: 243, wherein both codons 84 and 245 are replaced with codons that code for a non-aromatic amino acid.

The isolated nucleic acid can comprise a nucleic acid sequence having at least 97% sequence identity to SEQ ID NO: 244 or 247, wherein codon 84 codes for a non-aromatic amino acid.

The isolated nucleic acid can comprise a nucleic acid sequence having at least 98% sequence identity to SEQ ID NO: 244 or 247, wherein codon 84 codes for a non-aromatic amino acid.

The isolated nucleic acid can comprise a nucleic acid sequence having at least 99% sequence identity to SEQ ID NO: 244 or 247, wherein codon 84 codes for a non-aromatic amino acid.

The isolated nucleic acid can comprise a nucleic acid sequence having 100% sequence identity to SEQ ID NO: 244 or 247, wherein codon 84 codes for a non-aromatic amino acid.

The isolated nucleic acid can comprise a nucleic acid sequence having at least 97% sequence identity to SEQ ID NO: 245 or 248, wherein codon 245 codes for a non-aromatic amino acid.

The isolated nucleic acid can comprise a nucleic acid sequence having at least 98% sequence identity to SEQ ID NO: 245 or 248, wherein codon 245 codes for a non-aromatic amino acid.

The isolated nucleic acid can comprise a nucleic acid sequence having at least 99% sequence identity to SEQ ID NO: 245 or 248, wherein codon 245 codes for a non-aromatic amino acid.

The isolated nucleic acid can comprise a nucleic acid sequence having 100% sequence identity to SEQ ID NO: 245 or 248, wherein codon 245 codes for a non-aromatic amino acid.

The isolated nucleic acid can comprise a nucleic acid sequence having at least 97% sequence identity to SEQ ID NO: 246 or 249, wherein both codons 84 and 245 are replaced with codons that codes for a non-aromatic amino acid.

The isolated nucleic acid can comprise a nucleic acid sequence having at least 98% sequence identity to SEQ ID NO: 246 or 249, wherein both codons 84 and 245 are replaced with codons that codes for a non-aromatic amino acid.

The isolated nucleic acid can comprise a nucleic acid sequence having at least 99% sequence identity to SEQ ID NO: 246 or 249, wherein both codons 84 and 245 are replaced with codons that codes for a non-aromatic amino acid.

The isolated nucleic acid can comprise a nucleic acid sequence having 100% sequence identity to SEQ ID NO: 246 or 249, wherein both codons 84 and 245 are replaced with codons that codes for a non-aromatic amino acid.

Another isolated nucleic acid is provided. The isolated nucleic acid can comprise a nucleic acid sequence having at least 70% sequence identity to SEQ ID NO: 250, wherein codon 83 is replaced with a codon that codes for a non-aromatic amino acid.

The isolated nucleic acid can comprise a nucleic acid sequence having at least 75% sequence identity to SEQ ID NO: 250, wherein codon 83 is replaced with a codon that codes for a non-aromatic amino acid.

The isolated nucleic acid can comprise a nucleic acid sequence having at least 80% sequence identity to SEQ ID NO: 250, wherein codon 83 is replaced with a codon that codes for a non-aromatic amino acid.

The isolated nucleic acid can comprise a nucleic acid sequence having at least 85% sequence identity to SEQ ID NO: 250, wherein codon 83 is replaced with a codon that codes for a non-aromatic amino acid.

The isolated nucleic acid can comprise a nucleic acid sequence having at least 90% sequence identity to SEQ ID NO: 250, wherein codon 83 is replaced with a codon that codes for a non-aromatic amino acid.

The isolated nucleic acid can comprise a nucleic acid sequence having at least 95% sequence identity to SEQ ID NO: 250, wherein codon 83 is replaced with a codon that codes for a non-aromatic amino acid.

The isolated nucleic acid can comprise a nucleic acid sequence having at least 98% sequence identity to SEQ ID NO: 250, wherein codon 83 is replaced with a codon that codes for a non-aromatic amino acid.

The isolated nucleic acid can comprise a nucleic acid sequence having at least 99% sequence identity to SEQ ID NO: 250, wherein codon 83 is replaced with a codon that codes for a non-aromatic amino acid.

The isolated nucleic acid can comprise a nucleic acid sequence having at least 70% sequence identity to SEQ ID NO: 250, wherein codon 241 is replaced with a codon that codes for a non-aromatic amino acid.

The isolated nucleic acid can comprise a nucleic acid sequence having at least 75% sequence identity to SEQ ID NO: 250, wherein codon 241 is replaced with a codon that codes for a non-aromatic amino acid.

The isolated nucleic acid can comprise a nucleic acid sequence having at least 80% sequence identity to SEQ ID NO: 250, wherein codon 241 is replaced with a codon that codes for a non-aromatic amino acid.

The isolated nucleic acid can comprise a nucleic acid sequence having at least 85% sequence identity to SEQ ID NO: 250, wherein codon 241 is replaced with a codon that codes for a non-aromatic amino acid.

The isolated nucleic acid can comprise a nucleic acid sequence having at least 90% sequence identity to SEQ ID NO: 250, wherein codon 241 is replaced with a codon that codes for a non-aromatic amino acid.

The isolated nucleic acid can comprise a nucleic acid sequence having at least 95% sequence identity to SEQ ID NO: 250, wherein codon 241 is replaced with a codon that codes for a non-aromatic amino acid.

The isolated nucleic acid can comprise a nucleic acid sequence having at least 98% sequence identity to SEQ ID NO: 250, wherein codon 241 is replaced with a codon that codes for a non-aromatic amino acid.

The isolated nucleic acid can comprise a nucleic acid sequence having at least 99% sequence identity to SEQ ID NO: 250, wherein codon 241 is replaced with a codon that codes for a non-aromatic amino acid.

The isolated nucleic acid can comprise a nucleic acid sequence having at least 70% sequence identity to SEQ ID NO: 250, wherein both codons 83 and 241 are replaced with codons that codes for a non-aromatic amino acid.

The isolated nucleic acid can comprise a nucleic acid sequence having at least 75% sequence identity to SEQ ID NO: 250, wherein both codons 83 and 241 are replaced with codons that codes for a non-aromatic amino acid.

The isolated nucleic acid can comprise a nucleic acid sequence having at least 80% sequence identity to SEQ ID NO: 250, wherein both codons 83 and 241 are replaced with codons that codes for a non-aromatic amino acid.

The isolated nucleic acid can comprise a nucleic acid sequence having at least 85% sequence identity to SEQ ID NO: 250, wherein both codons 83 and 241 are replaced with codons that codes for a non-aromatic amino acid.

The isolated nucleic acid can comprise a nucleic acid sequence having at least 90% sequence identity to SEQ ID NO: 250, wherein both codons 83 and 241 are replaced with codons that codes for a non-aromatic amino acid.

The isolated nucleic acid can comprise a nucleic acid sequence having at least 95% sequence identity to SEQ ID NO: 250, wherein both codons 83 and 241 are replaced with codons that codes for a non-aromatic amino acid.

The isolated nucleic acid can comprise a nucleic acid sequence having at least 98% sequence identity to SEQ ID NO: 250, wherein both codons 83 and 241 are replaced with codons that codes for a non-aromatic amino acid.

The isolated nucleic acid can comprise a nucleic acid sequence having at least 99% sequence identity to SEQ ID NO: 250, wherein both codons 83 and 241 are replaced with codons that codes for a non-aromatic amino acid.

Another isolated nucleic acid is provided. The isolated nucleic acid can comprise a nucleic acid sequence having at least 70% sequence identity to SEQ ID NO: 294 or 295, wherein codon 83 codes for a non-aromatic amino acid.

The isolated nucleic acid can comprise a nucleic acid sequence having at least 75% sequence identity to SEQ ID NO: 294 or 295, wherein codon 83 codes for a non-aromatic amino acid.

The isolated nucleic acid can comprise a nucleic acid sequence having at least 80% sequence identity to SEQ ID NO: 294 or 295, wherein codon 83 codes for a non-aromatic amino acid.

The isolated nucleic acid can comprise a nucleic acid sequence having at least 85% sequence identity to SEQ ID NO: 294 or 295, wherein codon 83 codes for a non-aromatic amino acid.

The isolated nucleic acid can comprise a nucleic acid sequence having at least 90% sequence identity to SEQ ID NO: 294 or 295, wherein codon 83 codes for a non-aromatic amino acid.

The isolated nucleic acid can comprise a nucleic acid sequence having at least 95% sequence identity to SEQ ID NO: 294 or 295, wherein codon 83 codes for a non-aromatic amino acid.

The isolated nucleic acid can comprise a nucleic acid sequence having at least 98% sequence identity to SEQ ID NO: 294 or 295, wherein codon 83 codes for a non-aromatic amino acid.

The isolated nucleic acid can comprise a nucleic acid sequence having at least 99% sequence identity to SEQ ID NO: 294 or 295, wherein codon 83 codes for a non-aromatic amino acid.

The isolated nucleic acid can comprise a nucleic acid sequence having 100% sequence identity to SEQ ID NO: 294 or 295, wherein codon 83 codes for a non-aromatic amino acid.

The isolated nucleic acid can comprise a nucleic acid sequence having at least 70% sequence identity to SEQ ID NO: 296 or 297, wherein codon 241 codes for a non-aromatic amino acid.

The isolated nucleic acid can comprise a nucleic acid sequence having at least 75% sequence identity to SEQ ID NO: 296 or 297, wherein codon 241 codes for a non-aromatic amino acid.

The isolated nucleic acid can comprise a nucleic acid sequence having at least 80% sequence identity to SEQ ID NO: 296 or 297, wherein codon 241 codes for a non-aromatic amino acid.

The isolated nucleic acid can comprise a nucleic acid sequence having at least 85% sequence identity to SEQ ID NO: 296 or 297, wherein codon 241 codes for a non-aromatic amino acid.

The isolated nucleic acid can comprise a nucleic acid sequence having at least 90% sequence identity to SEQ ID NO: 296 or 297, wherein codon 241 codes for a non-aromatic amino acid.

The isolated nucleic acid can comprise a nucleic acid sequence having at least 95% sequence identity to SEQ ID NO: 296 or 297, wherein codon 241 codes for a non-aromatic amino acid.

The isolated nucleic acid can comprise a nucleic acid sequence having at least 98% sequence identity to SEQ ID NO: 296 or 297, wherein codon 241 codes for a non-aromatic amino acid.

The isolated nucleic acid can comprise a nucleic acid sequence having at least 99% sequence identity to SEQ ID NO: 296 or 297, wherein codon 241 codes for a non-aromatic amino acid.

The isolated nucleic acid can comprise a nucleic acid sequence having 100% sequence identity to SEQ ID NO: 296 or 297, wherein codon 241 codes for a non-aromatic amino acid. The isolated nucleic acid can comprise a nucleic acid sequence having at least 70% sequence identity to SEQ ID NO: 298 or 299, wherein both codons 83 and 241 code for a non-aromatic amino acid.

The isolated nucleic acid can comprise a nucleic acid sequence having at least 75% sequence identity to SEQ ID NO: 298 or 299, wherein both codons 83 and 241 code for a non-aromatic amino acid.

The isolated nucleic acid can comprise a nucleic acid sequence having at least 80% sequence identity to SEQ ID NO: 298 or 299, wherein both codons 83 and 241 code for a non-aromatic amino acid.

The isolated nucleic acid can comprise a nucleic acid sequence having at least 85% sequence identity to SEQ ID NO: 298 or 299, wherein both codons 83 and 241 code for a non-aromatic amino acid.

The isolated nucleic acid can comprise a nucleic acid sequence having at least 90% sequence identity to SEQ ID NO: 298 or 299, wherein both codons 83 and 241 code for a non-aromatic amino acid.

The isolated nucleic acid can comprise a nucleic acid sequence having at least 95% sequence identity to SEQ ID NO: 298 or 299, wherein both codons 83 and 241 code for a non-aromatic amino acid.

The isolated nucleic acid can comprise a nucleic acid sequence having at least 98% sequence identity to SEQ ID NO: 298 or 299, wherein both codons 83 and 241 code for a non-aromatic amino acid.

The isolated nucleic acid can comprise a nucleic acid sequence having at least 99% sequence identity to SEQ ID NO: 298 or 299, wherein both codons 83 and 241 code for a non-aromatic amino acid.

The isolated nucleic acid can comprise a nucleic acid sequence having 100% sequence identity to SEQ ID NO: 298 or 299, wherein both codons 83 and 241 code codes for a non-aromatic amino acid.

The non-aromatic amino acid can comprise a leucine (L), isoleucine (I), glycine (G), or valine (V).

The non-aromatic amino acid can comprise a leucine (L) or isoleucine (I) residue.

Another isolated nucleic acid is provided. The isolated nucleic acid can comprise a nucleic acid sequence having at least 76% identity to SEQ ID NO: 279.

The isolated nucleic acid can comprise a nucleic acid sequence having at least 78% identity to SEQ ID NO: 279.

The isolated nucleic acid can comprise a nucleic acid sequence having at least 80% identity to SEQ ID NO: 279.

The isolated nucleic acid can comprise a nucleic acid sequence having at least 85% identity to SEQ ID NO: 279.

The isolated nucleic acid can comprise a nucleic acid sequence having at least 90% identity to SEQ ID NO: 279.

The isolated nucleic acid can comprise a nucleic acid sequence having at least 95% identity to SEQ ID NO: 279.

The isolated nucleic acid can comprise a nucleic acid sequence having at least 98% identity to SEQ ID NO: 279.

The isolated nucleic acid can comprise a nucleic acid sequence having at least 99% identity to SEQ ID NO: 279.

The isolated nucleic acid can comprise a nucleic acid sequence having 100% identity to SEQ ID NO: 279.

Another isolated nucleic acid is provided. The isolated nucleic acid can comprise a nucleic acid sequence having at least 78% identity to SEQ ID NO: 275.

The isolated nucleic acid can comprise a nucleic acid sequence having at least 80% identity to SEQ ID NO: 275.

The isolated nucleic acid can comprise a nucleic acid sequence having at least 85% identity to SEQ ID NO: 275.

The isolated nucleic acid can comprise a nucleic acid sequence having at least 90% identity to SEQ ID NO: 275.

The isolated nucleic acid can comprise a nucleic acid sequence having at least 95% identity to SEQ ID NO: 275.

The isolated nucleic acid can comprise a nucleic acid sequence having at least 98% identity to SEQ ID NO: 275

The isolated nucleic acid can comprise a nucleic acid sequence having at least 99% identity to SEQ ID NO: 275.

The isolated nucleic acid can comprise a nucleic acid sequence having 100% identity to SEQ ID NO: 275.

Yet another isolated nucleic acid is provided. The isolated nucleic acid can comprise a nucleic acid sequence having at least 83% identity to SEQ ID NO: 264 or 265.

The isolated nucleic acid can comprise a nucleic acid sequence having at least 85% identity to SEQ ID NO: 264 or 265.

The isolated nucleic acid can comprise a nucleic acid sequence having at least 90% identity to SEQ ID NO: 264 or 265

The isolated nucleic acid can comprise a nucleic acid sequence having at least 95% identity to SEQ ID NO: 264 or 265.

The isolated nucleic acid can comprise a nucleic acid sequence having at least 98% identity to SEQ ID NO: 264 or 265

The isolated nucleic acid can comprise a nucleic acid sequence having at least 99% identity to SEQ ID NO: 264 or 265.

The isolated nucleic acid can comprise a nucleic acid sequence having 100% identity to SEQ ID NO: 264 or 265.

The isolated nucleic acid can comprise a nucleic acid sequence having at least 89% identity to SEQ ID NO: 259.

The isolated nucleic acid can comprise a nucleic acid sequence having at least 90% identity to SEQ ID NO: 259.

The isolated nucleic acid can comprise a nucleic acid sequence having at least 95% identity to SEQ ID NO: 259.

The isolated nucleic acid can comprise a nucleic acid sequence having at least 98% identity to SEQ ID NO: 259.

The isolated nucleic acid can comprise a nucleic acid sequence having at least 99% identity to SEQ ID NO: 259.

The isolated nucleic acid can comprise a nucleic acid sequence having 100% identity to SEQ ID NO: 259.

Yet Another Isolated

Another isolated nucleic acid is provided. The isolated nucleic acid comprises SEQ ID NO: 2, 3, 5, 7, 8, 11, 12, 13, 15, 16, 17, 18, 19, 20, 72, 77, 78, 80, 81, 82, 83, 84, 85, 86, 88, 91, 94, 96, 98, 99, 100, 101, 102, 103, 109, 112, 113, 114, 115, 243, 244, 245, 246, 247, 248, 249, 250, 259, 260, 264, 265, 266, 267, 273, 274, 275, 279, 294, 295, 296, 297, 298, or 299.

Yet another isolated nucleic acid is provided. The isolated nucleic acid consists of SEQ ID NO: 2, 3, 5, 7, 8, 11, 12, 13, 15, 16, 17, 18, 19, 20, 72, 77, 78, 80, 81, 82, 83, 84, 85, 86, 88, 91, 94, 96, 98, 99, 100, 101, 102, 103, 109, 112, 113, 114, 115, 243, 244, 245, 246, 247, 248, 249, 259, 260, 264, 265, 266, 267, 273, 274, 275, 279, 294, 295, 296, 297, 298, or 299.

A vector comprising any of the isolated nucleic acids and a heterologous nucleic acid sequence is provided. Any suitable vector can be used (e.g., a plasmid vector). Vectors preferably comprise a multiple cloning site into which the isolated nucleic acid can be easily inserted. Vectors also preferably comprise a selectable marker, such as an antibiotic resistance gene, such that microorganisms transformed, transfected, or mated with the vector can be readily identified and isolated. Where the vector is a plasmid, the plasmid suitably also comprises an origin of replication.

A host cell comprising the vector is also provided. The host cell suitably comprises a bacterial cell. A variety of host cells can be used, including any of those listed in Section I.K below.

E. Isolated Enzymes Comprising Amino Acid Substitutions at the First Position of the Amino Acid Sequence Isolated monooxygenase, phenolic acid decarboxylase, and chlorohydrolase enzymes having an amino acid substitution at the first position of the amino acid sequence are provided.

An isolated enzyme is provided. The isolated enzyme comprises an amino acid sequence having at least 70% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The isolated enzyme can comprise an amino acid sequence having at least 75% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The isolated enzyme can comprise an amino acid sequence having at least 80% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The isolated enzyme can comprise an amino acid sequence having at least 85% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The isolated enzyme can comprise an amino acid sequence having at least 90% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The isolated enzyme can comprise an amino acid sequence having at least 95% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The isolated enzyme can comprise an amino acid sequence having at least 98% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The isolated enzyme can comprise an amino acid sequence having at least 99% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

Another isolated enzyme is provided. The isolated enzyme comprises an amino acid sequence having at least 70% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The isolated enzyme can comprise an amino acid sequence having at least 75% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The isolated enzyme can comprise an amino acid sequence having at least 80% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The isolated enzyme can comprise an amino acid sequence having at least 85% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The isolated enzyme can comprise an amino acid sequence having at least 90% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The isolated enzyme can comprise an amino acid sequence having at least 95% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The isolated enzyme can comprise an amino acid sequence having at least 98% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The isolated enzyme can comprise an amino acid sequence having at least 99% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

Yet another isolated enzyme is provided. The isolated enzyme comprises an amino acid sequence having at least 70% identity to SEQ ID NO: 40, 71, or 261, wherein the amino acid sequence comprises a substitution of the valine at the first position of the sequence with a leucine.

The isolated enzyme can comprise an amino acid sequence having at least 75% identity to SEQ ID NO: 40, 71, or 261, wherein the amino acid sequence comprises a substitution of the valine at the first position of the sequence with a leucine.

The isolated enzyme can comprise an amino acid sequence having at least 80% identity to SEQ ID NO: 40, 71, or 261, wherein the amino acid sequence comprises a substitution of the valine at the first position of the sequence with a leucine.

The isolated enzyme can comprise an amino acid sequence having at least 85% identity to SEQ ID NO: 40, 71, or 261, wherein the amino acid sequence comprises a substitution of the valine at the first position of the sequence with a leucine.

The isolated enzyme can comprise an amino acid sequence having at least 90% identity to SEQ ID NO: 40, 71, or 261, wherein the amino acid sequence comprises a substitution of the valine at the first position of the sequence with a leucine.

The isolated enzyme can comprise an amino acid sequence having at least 95% identity to SEQ ID NO: 40, 71, or 261, wherein the amino acid sequence comprises a substitution of the valine at the first position of the sequence with a leucine.

The isolated enzyme can comprise an amino acid sequence having at least 98% identity to SEQ ID NO: 40, 71, or 261, wherein the amino acid sequence comprises a substitution of the valine at the first position of the sequence with a leucine.

The isolated enzyme can comprise an amino acid sequence having at least 99% identity to SEQ ID NO: 40, 71, or 261, wherein the amino acid sequence comprises a substitution of the valine at the first position of the sequence with a leucine.

A further isolated enzyme is provided. The isolated enzyme comprises an amino acid sequence having at least 70% identity to SEQ ID NO: 139, wherein the amino acid sequence comprises a substitution of the leucine at the first position of the sequence with a methionine or valine.

The isolated enzyme can comprise an amino acid sequence having at least 75% identity to SEQ ID NO: 139, wherein the amino acid sequence comprises a substitution of the leucine at the first position of the sequence with a methionine or valine.

The isolated enzyme can comprise an amino acid sequence having at least 80% identity to SEQ ID NO: 139, wherein the amino acid sequence comprises a substitution of the leucine at the first position of the sequence with a methionine or valine.

The isolated enzyme can comprise an amino acid sequence having at least 85% identity to SEQ ID NO: 139, wherein the amino acid sequence comprises a substitution of the leucine at the first position of the sequence with a methionine or valine.

The isolated enzyme can comprise an amino acid sequence having at least 90% identity to SEQ ID NO: 139, wherein the amino acid sequence comprises a substitution of the leucine at the first position of the sequence with a methionine or valine.

The isolated enzyme can comprise an amino acid sequence having at least 95% identity to SEQ ID NO: 139, wherein the amino acid sequence comprises a substitution of the leucine at the first position of the sequence with a methionine or valine.

The isolated enzyme can comprise an amino acid sequence having at least 98% identity to SEQ ID NO: 139, wherein the amino acid sequence comprises a substitution of the leucine at the first position of the sequence with a methionine or valine.

The isolated enzyme can comprise an amino acid sequence having at least 99% identity to SEQ ID NO: 139, wherein the amino acid sequence comprises a substitution of the leucine at the first position of the sequence with a methionine or valine.

In any of the enzymes comprising a substitution at the first position of the amino acid sequence, the substitution at the first position can be the sole modification in the sequence.

F. Salicylate Monooxygenase Enzymes (SM1 and SM3)

Amino acid sequences for a salicylate monooxygenase (SM1) from *Bacillus cereus* strain B377 and for a salicylate monooxygenase (SM3) from *Pseudommas putida* (SEQ ID NO: 258) are provided in Table 2 above. Amino acid sequences for modified forms of these enzymes are provided in Tables 3B and 3D above.

An isolated enzyme is provided comprising an amino acid sequence having at least 99.3% identity to SEQ ID NO: 251.

The isolated enzyme can comprise an amino acid sequence having at least 99.5% identity to SEQ ID NO: 251.

The isolated enzyme can comprise an amino acid sequence having 100% identity to SEQ ID NO: 251.

The isolated enzyme can comprise an amino acid sequence having at least 70% identity to SEQ ID NO: 251, wherein the phenylalanine residue at amino acid position 84 of SEQ ID NO: 251 is substituted with a non-aromatic amino acid.

The isolated enzyme can comprise an amino acid sequence having at least 75% identity to SEQ ID NO: 251, wherein the phenylalanine residue at amino acid position 84 of SEQ ID NO: 251 is substituted with a non-aromatic amino acid.

The isolated enzyme can comprise an amino acid sequence having at least 80% identity to SEQ ID NO: 251, wherein the phenylalanine residue at amino acid position 84 of SEQ ID NO: 251 is substituted with a non-aromatic amino acid.

The isolated enzyme can comprise an amino acid sequence having at least 85% identity to SEQ ID NO: 251, wherein the phenylalanine residue at amino acid position 84 of SEQ ID NO: 251 is substituted with a non-aromatic amino acid.

The isolated enzyme can comprise an amino acid sequence having at least 90% identity to SEQ ID NO: 251, wherein the phenylalanine residue at amino acid position 84 of SEQ ID NO: 251 is substituted with a non-aromatic amino acid.

The isolated enzyme can comprise an amino acid sequence having at least 95% identity to SEQ ID NO: 251, wherein the phenylalanine residue at amino acid position 84 of SEQ ID NO: 251 is substituted with a non-aromatic amino acid.

The isolated enzyme can comprise an amino acid sequence having at least 98% identity to SEQ ID NO: 251, wherein the phenylalanine residue at amino acid position 84 of SEQ ID NO: 251 is substituted with a non-aromatic amino acid.

The isolated enzyme can comprise an amino acid sequence having at least 99% identity to SEQ ID NO: 251, wherein the phenylalanine residue at amino acid position 84 of SEQ ID NO: 251 is substituted with a non-aromatic amino acid.

The isolated enzyme can comprise an amino acid sequence having at least 70% identity to SEQ ID NO: 251, wherein the tyrosine residue at amino acid position 245 of SEQ ID NO: 251 is substituted with a non-aromatic acid.

The isolated enzyme can comprise an amino acid sequence having at least 75% identity to SEQ ID NO: 251, wherein the tyrosine residue at amino acid position 245 of SEQ ID NO: 251 is substituted with a non-aromatic acid.

The isolated enzyme can comprise an amino acid sequence having at least 80% identity to SEQ ID NO: 251, wherein the tyrosine residue at amino acid position 245 of SEQ ID NO: 251 is substituted with a non-aromatic acid.

The isolated enzyme can comprise an amino acid sequence having at least 85% identity to SEQ ID NO: 251, wherein the tyrosine residue at amino acid position 245 of SEQ ID NO: 251 is substituted with a non-aromatic acid.

The isolated enzyme can comprise an amino acid sequence having at least 90% identity to SEQ ID NO: 251, wherein the tyrosine residue at amino acid position 245 of SEQ ID NO: 251 is substituted with a non-aromatic acid.

The isolated enzyme can comprise an amino acid sequence having at least 95% identity to SEQ ID NO: 251, wherein the tyrosine residue at amino acid position 245 of SEQ ID NO: 251 is substituted with a non-aromatic acid.

The isolated enzyme can comprise an amino acid sequence having at least 98% identity to SEQ ID NO: 251, wherein the tyrosine residue at amino acid position 245 of SEQ ID NO: 251 is substituted with a non-aromatic acid.

The isolated enzyme can comprise an amino acid sequence having at least 99% identity to SEQ ID NO: 251, wherein the tyrosine residue at amino acid position 245 of SEQ ID NO: 251 is substituted with a non-aromatic acid.

The isolated enzyme can comprise an amino acid sequence having at least 70% identity to SEQ ID NO: 251, wherein both the phenylalanine residue at amino acid position 84 of SEQ ID NO: 251 and the tyrosine residue at amino acid position 245 of SEQ ID NO: 251 are substituted with non-aromatic amino acids.

The isolated enzyme can comprise an amino acid sequence having at least 75% identity to SEQ ID NO: 251, wherein both the phenylalanine residue at amino acid position 84 of SEQ ID NO: 251 and the tyrosine residue at amino acid position 245 of SEQ ID NO: 251 are substituted with non-aromatic amino acids.

The isolated enzyme can comprise an amino acid sequence having at least 80% identity to SEQ ID NO: 251, wherein both the phenylalanine residue at amino acid position 84 of SEQ ID NO: 251 and the tyrosine residue at amino acid position 245 of SEQ ID NO: 251 are substituted with non-aromatic amino acids.

The isolated enzyme can comprise an amino acid sequence having at least 85% identity to SEQ ID NO: 251, wherein both the phenylalanine residue at amino acid position 84 of SEQ ID NO: 251 and the tyrosine residue at amino acid position 245 of SEQ ID NO: 251 are substituted with non-aromatic amino acids.

The isolated enzyme can comprise an amino acid sequence having at least 90% identity to SEQ ID NO: 251, wherein both the phenylalanine residue at amino acid position 84 of SEQ ID NO: 251 and the tyrosine residue at amino acid position 245 of SEQ ID NO: 251 are substituted with non-aromatic amino acids.

The isolated enzyme can comprise an amino acid sequence having at least 95% identity to SEQ ID NO: 251, wherein both the phenylalanine residue at amino acid position 84 of SEQ ID NO: 251 and the tyrosine residue at amino acid position 245 of SEQ ID NO: 251 are substituted with non-aromatic amino acids.

The isolated enzyme can comprise an amino acid sequence having at least 98% identity to SEQ ID NO: 251, wherein both the phenylalanine residue at amino acid position 84 of SEQ ID NO: 251 and the tyrosine residue at amino acid position 245 of SEQ ID NO: 251 are substituted with non-aromatic amino acids.

The isolated enzyme can comprise an amino acid sequence having at least 99% identity to SEQ ID NO: 251, wherein both the phenylalanine residue at amino acid position 84 of SEQ ID NO: 251 and the tyrosine residue at amino acid position 245 of SEQ ID NO: 251 are substituted with non-aromatic amino acids.

Still another isolated enzyme is provided. The isolated enzyme can comprise an amino acid sequence having at least 70% identity to SEQ ID NO: 251, wherein the phenylalanine residue at amino acid at position 83 of SEQ ID NO: 258 is substituted with a non-aromatic amino acid.

The isolated enzyme can comprise an amino acid sequence having at least 75% identity to SEQ ID NO: 258, wherein the phenylalanine residue at amino acid at position 83 of SEQ ID NO: 258 is substituted with a non-aromatic amino acid.

The isolated enzyme can comprise an amino acid sequence having at least 80% identity to SEQ ID NO: 258, wherein the phenylalanine residue at amino acid at position 83 of SEQ ID NO: 258 is substituted with a non-aromatic amino acid.

The isolated enzyme can comprise an amino acid sequence having at least 85% identity to SEQ ID NO: 258, wherein the phenylalanine residue at amino acid at position 83 of SEQ ID NO: 258 is substituted with a non-aromatic amino acid.

The isolated enzyme can comprise an amino acid sequence having at least 90% identity to SEQ ID NO: 258, wherein the phenylalanine residue at amino acid at position 83 of SEQ ID NO: 258 is substituted with a non-aromatic amino acid.

The isolated enzyme can comprise an amino acid sequence having at least 95% identity to SEQ ID NO: 258, wherein the phenylalanine residue at amino acid at position 83 of SEQ ID NO: 258 is substituted with a non-aromatic amino acid.

The isolated enzyme can comprise an amino acid sequence having at least 98% identity to SEQ ID NO: 258, wherein the phenylalanine residue at amino acid at position 83 of SEQ ID NO: 258 is substituted with a non-aromatic amino acid.

The isolated enzyme can comprise an amino acid sequence having at least 99% identity to SEQ ID NO: 258, wherein the phenylalanine residue at amino acid at position 83 of SEQ ID NO: 258 is substituted with a non-aromatic amino acid.

The isolated enzyme can comprise an amino acid sequence having at least 70% identity to SEQ ID NO: 258, wherein the phenylalanine residue at amino acid at position 241 of SEQ ID NO: 258 is substituted with a non-aromatic amino acid.

The isolated enzyme can comprise an amino acid sequence having at least 75% identity to SEQ ID NO: 258, wherein the phenylalanine residue at amino acid at position 241 of SEQ ID NO: 258 is substituted with a non-aromatic amino acid The isolated enzyme can comprise an amino acid sequence having at least 80% identity to SEQ ID NO: 258, wherein the phenylalanine residue at amino acid at position 241 of SEQ ID NO: 258 is substituted with a non-aromatic amino acid.

The isolated enzyme can comprise an amino acid sequence having at least 85% identity to SEQ ID NO: 258, wherein the phenylalanine residue at amino acid at position 241 of SEQ ID NO: 258 is substituted with a non-aromatic amino acid.

The isolated enzyme can comprise an amino acid sequence having at least 90% identity to SEQ ID NO: 258, wherein the phenylalanine residue at amino acid at position 241 of SEQ ID NO: 258 is substituted with a non-aromatic amino acid.

The isolated enzyme can comprise an amino acid sequence having at least 95% identity to SEQ ID NO: 258, wherein the phenylalanine residue at amino acid at position 241 of SEQ ID NO: 258 is substituted with a non-aromatic amino acid.

The isolated enzyme can comprise an amino acid sequence having at least 98% identity to SEQ ID NO: 258, wherein the phenylalanine residue at amino acid at position 241 of SEQ ID NO: 258 is substituted with a non-aromatic amino acid.

The isolated enzyme can comprise an amino acid sequence having at least 99% identity to SEQ ID NO: 258, wherein the phenylalanine residue at amino acid at position 241 of SEQ ID NO: 258 is substituted with a non-aromatic amino acid.

The isolated enzyme can comprise an amino acid sequence having at least 70% identity to SEQ ID NO: 258, wherein both the phenylalanine residue at amino acid at position 83 of SEQ ID NO: 258 and the phenylalanine residue at amino acid at position 241 of SEQ ID NO: 258 are substituted with non-aromatic amino acids.

The isolated enzyme can comprise an amino acid sequence having at least 75% identity to SEQ ID NO: 258, wherein both the phenylalanine residue at amino acid at position 83 of SEQ ID NO: 258 and the phenylalanine residue at amino acid at position 241 of SEQ ID NO: 258 are substituted with non-aromatic amino acids.

The isolated enzyme can comprise an amino acid sequence having at least 80% identity to SEQ ID NO: 258, wherein both the phenylalanine residue at amino acid at position 83 of SEQ ID NO: 258 and the phenylalanine residue at amino acid at position 241 of SEQ ID NO: 258 are substituted with non-aromatic amino acids.

The isolated enzyme can comprise an amino acid sequence having at least 85% identity to SEQ ID NO: 258, wherein both the phenylalanine residue at amino acid at position 83 of SEQ ID NO: 258 and the phenylalanine residue at amino acid at position 241 of SEQ ID NO: 258 are substituted with non-aromatic amino acids.

The isolated enzyme can comprise an amino acid sequence having at least 90% identity to SEQ ID NO: 258, wherein both the phenylalanine residue at amino acid at position 83 of SEQ ID NO: 258 and the phenylalanine residue at amino acid at position 241 of SEQ ID NO: 258 are substituted with non-aromatic amino acids.

The isolated enzyme can comprise an amino acid sequence having at least 95% identity to SEQ ID NO: 258, wherein both the phenylalanine residue at amino acid at position 83 of SEQ ID NO: 258 and the phenylalanine residue at amino acid at position 241 of SEQ ID NO: 258 are substituted with non-aromatic amino acids.

The isolated enzyme can comprise an amino acid sequence having at least 98% identity to SEQ ID NO: 258, wherein both the phenylalanine residue at amino acid at position 83 of SEQ ID NO: 258 and the phenylalanine residue at amino acid at position 241 of SEQ ID NO: 258 are substituted with non-aromatic amino acids.

The isolated enzyme can comprise an amino acid sequence having at least 99% identity to SEQ ID NO: 258, wherein both the phenylalanine residue at amino acid at position 83 of SEQ ID NO: 258 and the phenylalanine residue at amino acid at position 241 of SEQ ID NO: 258 are substituted with non-aromatic amino acids.

The non-aromatic amino acid can comprise a leucine (L), an isoleucine (I), glycine (G), or valine (V).

For example, the non-aromatic amino acid can comprise a leucine (L) or isoleucine (I) residue.

Still another isolated enzyme is provided. The isolated enzyme can comprise SEQ ID NO: 251, 252, 253, 254, 255, 256, 257, 300, 301, 302, 303, 304, or 305.

The isolated enzyme can consist of SEQ ID NO: 251, 252, 253, 254, 255, 256, 257, 300, 301, 302, 303, 304, or 305.

G. TfdA Dioxygenase Having an A198V Mutation

An amino acid sequence for a 2,4-D-alpha ketoglutarate dioxygenase (TfdA) enzyme derived form *Bacillus aryabhattai* and having an A198V mutation is provided as SEQ ID NO: 277 in Table 7B above.

Still another isolated enzyme is provided. The isolated enzyme can comprise an amino acid sequence having at least 70% identity to SEQ ID NO: 276, wherein the alanine residue at position 198 of SEQ ID NO: 276 is replaced with a valine residue.

The isolated enzyme can comprise an amino acid sequence having at least 75% identity to SEQ ID NO: 276, wherein the alanine residue at position 198 of SEQ ID NO: 276 is replaced with a valine residue.

The isolated enzyme can comprise an amino acid sequence having at least 80% identity to SEQ ID NO: 276, wherein the alanine residue at position 198 of SEQ ID NO: 276 is replaced with a valine residue.

The isolated enzyme can comprise an amino acid sequence having at least 85% identity to SEQ ID NO: 276, wherein the alanine residue at position 198 of SEQ ID NO: 276 is replaced with a valine residue.

The isolated enzyme can comprise an amino acid sequence having at least 90% identity to SEQ ID NO: 276, wherein the alanine residue at position 198 of SEQ ID NO: 276 is replaced with a valine residue.

The isolated enzyme can comprise an amino acid sequence having at least 95% identity to SEQ ID NO: 276, wherein the alanine residue at position 198 of SEQ ID NO: 276 is replaced with a valine residue.

The isolated enzyme can comprise an amino acid sequence having at least 98% identity to SEQ ID NO: 276, wherein the alanine residue at position 198 of SEQ ID NO: 276 is replaced with a valine residue.

The isolated enzyme can comprise an amino acid sequence having at least 99% identity to SEQ ID NO: 276, wherein the alanine residue at position 198 of SEQ ID NO: 276 is replaced with a valine residue.

The isolated enzyme can comprise SEQ ID NO: 277.
The isolated enzyme can consist of SEQ ID NO: 277.

H. Other Isolated Enzymes

Another isolated enzyme is provided. The isolated enzyme can comprise an amino acid sequence having at least 98.5% identity to SEQ ID NO: 261.

The isolated enzyme can comprise an amino acid sequence having at least 99% identity to SEQ ID NO: 261.

The isolated enzyme can comprise an amino acid sequence having 100% identity to SEQ ID NO: 261.

The isolated enzyme can comprise an amino acid sequence having at least 99% identity to SEQ ID NO: 272.

The isolated enzyme can comprise an amino acid sequence having 100% identity to SEQ ID NO: 272.

The isolated enzyme can comprise an amino acid sequence having at least 99.8% identity to SEQ ID NO: 269.

The isolated enzyme can comprise an amino acid sequence having 100% identity to SEQ ID NO: 269.

The isolated enzyme can comprise SEQ ID NO: 261, 269, 270, or 272.

The isolated enzyme can consist of SEQ ID NO: 261, 269, 270, or 272.

I. Enzymes for Use in the Compositions, Treated Seeds, and Methods

In any of the composition, treated seeds, or methods described herein, the enzyme can comprise an amino acid sequence having at least 70% identity to any one of SEQ ID NOs. 21-71, 73, 126-178, 251-258, 261, 262, 268-272, 276-278, 281, 284, and 300-305.

The enzyme can comprise an amino acid sequence having at least 75% identity to any one of SEQ ID NOs. 21-71, 73, 126-178, 251-258, 261, 262, 268-272, 276-278, 281, 284, and 300-305.

The enzyme can comprise an amino acid sequence having at least 80% identity to any one of SEQ ID NOs. 21-71, 73, 126-178, 251-258, 261, 262, 268-272, 276-278, 281, 284, and 300-305.

The enzyme can comprise an amino acid sequence having at least 85% identity to any one of SEQ ID NOs. 21-71, 73, 126-178, 251-258, 261, 262, 268-272, 276-278, 281, 284, and 300-305.

The enzyme can comprise an amino acid sequence having at least 90% identity to any one of SEQ ID NOs. 21-71, 73, 126-178, 251-258, 261, 262, 268-272, 276-278, 281, 284, and 300-305.

The enzyme can comprise an amino acid sequence having at least 95% identity to any one of SEQ ID NOs. 21-71, 73, 126-178, 251-258, 261, 262, 268-272, 276-278, 281, 284, and 300-305.

The enzyme can comprise an amino acid sequence having at least 98% identity to any one of SEQ ID NOs. 21-71, 73, 126-178, 251-258, 261, 262, 268-272, 276-278, 281, 284, and 300-305.

The enzyme can comprise an amino acid sequence having at least 99% identity to any one of SEQ ID NOs. 21-71, 73, 126-178, 251-258, 261, 262, 268-272, 276-278, 281, 284, and 300-305.

The enzyme can comprise an amino acid sequence having 100% identity to any one of SEQ ID NOs. 21-71, 73, 126-178, 251-258, 261, 262, 268-272, 276-278, 281, 284, and 300-305.

In any of the composition, treated seeds, or methods described herein, the enzyme can comprise an amino acid sequence having at least 70% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The enzyme can comprise an amino acid sequence having at least 75% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The enzyme can comprise an amino acid sequence having at least 80% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The enzyme can comprise an amino acid sequence having at least 85% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The enzyme can comprise an amino acid sequence having at least 90% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The enzyme can comprise an amino acid sequence having at least 95% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The enzyme can comprise an amino acid sequence having at least 98% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

The enzyme can comprise an amino acid sequence having at least 99% identity to any one of SEQ ID NOs. 21-39, 41-70, 73, 126-138, 140-178, 251-258, 262, 268, 269, 270, 271, 272, 276, 277, 278, 281, 284, and 300-305, wherein the amino acid sequence comprises a substitution of the methionine at the first position of the sequence with a valine.

In any of the composition, treated seeds, or methods described herein, the enzyme can comprise an amino acid sequence having at least 70% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The enzyme can comprise an amino acid sequence having at least 75% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The enzyme can comprise an amino acid sequence having at least 80% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The enzyme can comprise an amino acid sequence having at least 85% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The enzyme can comprise an amino acid sequence having at least 90% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The enzyme can comprise an amino acid sequence having at least 95% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The enzyme can comprise an amino acid sequence having at least 98% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

The enzyme can comprise an amino acid sequence having at least 99% identity to any one of SEQ ID NOs. 21-39, 41-70, 73, 126-132, 134, 136, 137, 140-143, 146-157, 159, 160, 162-178, 251-258, 262, 268, 269, 270, 271, 272, 276, 277, 278, 281, 284, and 300-305, wherein the amino acid sequence comprises a substitution of the methionine at the first position of the sequence with a leucine.

In any of the composition, treated seeds, or methods described herein, the enzyme can comprise an amino acid sequence having at least 70% identity to SEQ ID NO: 40, 71, or 261, wherein the amino acid sequence comprises a substitution of the valine at the first position of the sequence with a leucine.

The enzyme can comprise an amino acid sequence having at least 75% identity to SEQ ID NO: 40, 71, or 261, wherein the amino acid sequence comprises a substitution of the valine at the first position of the sequence with a leucine.

The enzyme can comprise an amino acid sequence having at least 80% identity to SEQ ID NO: 40, 71, or 261, wherein the amino acid sequence comprises a substitution of the valine at the first position of the sequence with a leucine.

The enzyme can comprise an amino acid sequence having at least 85% identity to SEQ ID NO: 40, 71, or 261, wherein the amino acid sequence comprises a substitution of the valine at the first position of the sequence with a leucine.

The enzyme can comprise an amino acid sequence having at least 90% identity to SEQ ID NO: 40, 71, or 261, wherein the amino acid sequence comprises a substitution of the valine at the first position of the sequence with a leucine.

The enzyme can comprise an amino acid sequence having at least 95% identity to SEQ ID NO: 40, 71, or 261, wherein the amino acid sequence comprises a substitution of the valine at the first position of the sequence with a leucine.

The enzyme can comprise an amino acid sequence having at least 98% identity to SEQ ID NO: 40, 71, or 261, wherein the amino acid sequence comprises a substitution of the valine at the first position of the sequence with a leucine.

The enzyme can comprise an amino acid sequence having at least 99% identity to SEQ ID NO: 40, 71, or 261, wherein the amino acid sequence comprises a substitution of the valine at the first position of the sequence with a leucine.

In any of the composition, treated seeds, or methods described herein, the enzyme can comprise an amino acid sequence having at least 70% to SEQ ID NO: 139, wherein the amino acid sequence comprises a substitution of the leucine at the first position of the sequence with a methionine or valine.

The enzyme can comprise an amino acid sequence having at least 75% to SEQ ID NO: 139, wherein the amino acid sequence comprises a substitution of the leucine at the first position of the sequence with a methionine or valine.

The enzyme can comprise an amino acid sequence having at least 80% to SEQ ID NO: 139, wherein the amino acid sequence comprises a substitution of the leucine at the first position of the sequence with a methionine or valine.

The enzyme can comprise an amino acid sequence having at least 85% to SEQ ID NO: 139, wherein the amino acid sequence comprises a substitution of the leucine at the first position of the sequence with a methionine or valine.

The enzyme can comprise an amino acid sequence having at least 90% to SEQ ID NO: 139, wherein the amino acid sequence comprises a substitution of the leucine at the first position of the sequence with a methionine or valine.

The enzyme can comprise an amino acid sequence having at least 95% to SEQ ID NO: 139, wherein the amino acid sequence comprises a substitution of the leucine at the first position of the sequence with a methionine or valine.

The enzyme can comprise an amino acid sequence having at least 98% to SEQ ID NO: 139, wherein the amino acid sequence comprises a substitution of the leucine at the first position of the sequence with a methionine or valine.

The enzyme can comprise an amino acid sequence having at least 99% to SEQ ID NO: 139, wherein the amino acid sequence comprises a substitution of the leucine at the first position of the sequence with a methionine or valine.

In any of the composition, treated seeds, or methods described herein, the enzyme can comprise a monooxygenase.

For example, the monooxygenase can comprise an amino acid sequence having at least 70% identity to any one of SEQ ID NOs. 21-71, 251-258, 261, 262, 268-272, and 300-305.

The monooxygenase can comprise an amino acid sequence having at least 75% identity to any one of SEQ ID NOs. 21-71, 251-258, 261, 262, 268-272, and 300-305.

The monooxygenase can comprise an amino acid sequence having at least 80% identity to any one of SEQ ID NOs. 21-71, 251-258, 261, 262, 268-272, and 300-305.

The monooxygenase can comprise an amino acid sequence having at least 85% identity to any one of SEQ ID NOs. 21-71, 251-258, 261, 262, 268-272, and 300-305.

The monooxygenase can comprise an amino acid sequence having at least 90% identity to any one of SEQ ID NOs. 21-71, 251-258, 261, 262, 268-272, and 300-305.

The monooxygenase can comprise an amino acid sequence having at least 95% identity to any one of SEQ ID NOs. 21-71, 251-258, 261, 262, 268-272, and 300-305.

The monooxygenase can comprise an amino acid sequence having at least 98% identity to any one of SEQ ID NOs. 21-71, 251-258, 261, 262, 268-272, and 300-305.

The monooxygenase can comprise an amino acid sequence having at least 99% identity to any one of SEQ ID NOs. 21-71, 251-258, 261, 262, 268-272, and 300-305.

The monooxygenase can comprise an amino acid sequence having 100% identity to any one of SEQ ID NOs. 21-71, 251-258, 261, 262, 268-272, and 300-305.

The monooxygenase can comprise an amino acid sequence having at least 70% identity to any one of SEQ ID NOs. 21-39, 41-70, 251-258, 262, and 268-272, and 300-305, wherein the amino acid sequence comprises a substitution of the methionine at the first position of the sequence with a leucine or valine.

The monooxygenase can comprise an amino acid sequence having at least 75% identity to any one of SEQ ID NOs. 21-39, 41-70, 251-258, 262, and 268-272, and 300-

305, wherein the amino acid sequence comprises a substitution of the methionine at the first position of the sequence with a leucine or valine.

The monooxygenase can comprise an amino acid sequence having at least 80% identity to any one of SEQ ID NOs. 21-39, 41-70, 251-258, 262, and 268-272, and 300-305, wherein the amino acid sequence comprises a substitution of the methionine at the first position of the sequence with a leucine or valine.

The monooxygenase can comprise an amino acid sequence having at least 85% identity to any one of SEQ ID NOs. 21-39, 41-70, 251-258, 262, and 268-272, and 300-305, wherein the amino acid sequence comprises a substitution of the methionine at the first position of the sequence with a leucine or valine.

The monooxygenase can comprise an amino acid sequence having at least 90% identity to any one of SEQ ID NOs. 21-39, 41-70, 251-258, 262, and 268-272, and 300-305, wherein the amino acid sequence comprises a substitution of the methionine at the first position of the sequence with a leucine or valine.

The monooxygenase can comprise an amino acid sequence having at least 95% identity to any one of SEQ ID NOs. 21-39, 41-70, 251-258, 262, and 268-272, and 300-305, wherein the amino acid sequence comprises a substitution of the methionine at the first position of the sequence with a leucine or valine.

The monooxygenase can comprise an amino acid sequence having at least 98% identity to any one of SEQ ID NOs. 21-39, 41-70, 251-258, 262, and 268-272, and 300-305, wherein the amino acid sequence comprises a substitution of the methionine at the first position of the sequence with a leucine or valine.

The monooxygenase can comprise an amino acid sequence having at least 99% identity to any one of SEQ ID NOs. 21-39, 41-70, 251-258, 262, and 268-272, and 300-305, wherein the amino acid sequence comprises a substitution of the methionine at the first position of the sequence with a leucine or valine.

The monooxygenase can comprise an amino acid sequence having at least 70%, at least 75%, at least 80%, at least 85%, at least 90%, at least 95%, at least 98%, or at least 99% identity to SEQ ID NO: 40, 71, or 261, wherein the amino acid sequence comprises a substitution of the valine at the first position of the sequence with a leucine.

The monooxygenase can comprise an amino acid sequence having at least 70% identity to any one of SEQ ID NOs. 21-40, 251-258, 261, 262, and 268-272, and 300-305.

The monooxygenase can comprise an amino acid sequence having at least 75% identity to any one of SEQ ID NOs. 21-40, 251-258, 261, 262, and 268-272, and 300-305.

The monooxygenase can comprise an amino acid sequence having at least 80% identity to any one of SEQ ID NOs. 21-40, 251-258, 261, 262, and 268-272, and 300-305.

The monooxygenase can comprise an amino acid sequence having at least 85% identity to any one of SEQ ID NOs. 21-40, 251-258, 261, 262, and 268-272, and 300-305.

The monooxygenase can comprise an amino acid sequence having at least 90% identity to any one of SEQ ID NOs. 21-40, 251-258, 261, 262, and 268-272, and 300-305.

The monooxygenase can comprise an amino acid sequence having at least 95% identity to any one of SEQ ID NOs. 21-40, 251-258, 261, 262, and 268-272, and 300-305.

The monooxygenase can comprise an amino acid sequence having at least 98% identity to any one of SEQ ID NOs. 21-40, 251-258, 261, 262, and 268-272, and 300-305.

The monooxygenase can comprise an amino acid sequence having at least 99% identity to any one of SEQ ID NOs. 21-40, 251-258, 261, 262, and 268-272, and 300-305.

The monooxygenase can comprise an amino acid sequence having 100% identity to any one of SEQ ID NOs. 21-40.

In any of the composition, treated seeds, or methods described herein comprising a monooxygenase, the monooxygenase can comprise a salicylate monooxygenase, a hydroxybenzoate monooxygenase, or a hydroxyphenylacetate monooxygenase, or a combination of any thereof.

For example, the salicylate monooxygenase can comprise a *Bacillus* salicylate monooxygenase (e.g., a *Bacillus cereus* salicylate monooxygenase) a *Pseudomonas* monooxygenase, or a *Pseudomonas putida* monooxygenase.

The hydroxyphenylacetate monooxygenase can comprise a *Bacillus* hydroxyphenylacetate monooxygenase (e.g., a *Bacillus cereus* hydroxyphenylacetate monooxygenase).

The hydroxybenzoate monooxygenase can comprise a *Bacillus* hydroxybenzoate monooxygenase (e.g., a *Bacillus cereus* hydroxybenzoate monooxygenase, or a *Bacillus pseudomycoides* hydroxybenzoate monooxygenase).

Where the monooxygenase comprises a salicylate monooxygenase, the salicylate monooxygenase can comprise an amino acid sequence having at least 70% identity to any one of SEQ ID NOs. 21, 41-50, 251-258, and 300-305.

The salicylate monooxygenase can comprise an amino acid sequence having at least 75% identity to any one of SEQ ID NOs. 21, 41-50, 251-258, and 300-305.

The salicylate monooxygenase can comprise an amino acid sequence having at least 80% identity to any one of SEQ ID NOs. 21, 41-50, 251-258, and 300-305.

The salicylate monooxygenase can comprise an amino acid sequence having at least 85% identity to any one of SEQ ID NOs. 21, 41-50, 251-258, and 300-305.

The salicylate monooxygenase can comprise an amino acid sequence having at least 90% identity to any one of SEQ ID NOs. 21, 41-50, 251-258, and 300-305.

The salicylate monooxygenase can comprise an amino acid sequence having at least 95% identity to any one of SEQ ID NOs. 21, 41-50, 251-258, and 300-305.

The salicylate monooxygenase can comprise an amino acid sequence having at least 98% identity to any one of SEQ ID NOs. 21, 41-50, 251-258, and 300-305.

The salicylate monooxygenase can comprise an amino acid sequence having at least 99% identity to any one of SEQ ID NOs 21, 41-50, 251-258, and 300-305.

The salicylate monooxygenase can comprise an amino acid sequence having 100% identity to any one of SEQ ID NOs. 21, 41-50, 251-258, and 300-305.

For example, the salicylate monooxygenase can comprise an amino acid sequence having at least 70% identity to SEQ ID NO: 21, 251-258, and 300-305.

The salicylate monooxygenase can comprise an amino acid sequence having at least 75% identity to SEQ ID NO: 21, 251-258, and 300-305.

The salicylate monooxygenase can comprise an amino acid sequence having at least 80% identity to SEQ ID NO: 21, 251-258, and 300-305.

The salicylate monooxygenase can comprise an amino acid sequence having at least 85% identity to SEQ ID NO: 21, 251-258, and 300-305.

The salicylate monooxygenase can comprise an amino acid sequence having at least 90% identity to SEQ ID NO: 21, 251-258, and 300-305.

The salicylate monooxygenase can comprise an amino acid sequence having at least 95% identity to SEQ ID NO: 21, 251-258, and 300-305.

The salicylate monooxygenase can comprise an amino acid sequence having at least 98% identity to SEQ ID NO: 21, 251-258, and 300-305.

The salicylate monooxygenase can comprise an amino acid sequence having at least 99% identity to SEQ ID NO: 21, 251-258, and 300-305.

The salicylate monooxygenase can comprise an amino acid sequence having 100% identity to SEQ ID NO: 21, 251-258, and 300-305.

The salicylate monooxygenase can comprise an amino acid sequence having at least 70% identity to SEQ ID NO: 21, 251-258, and 300-305, wherein the amino acid sequence comprises a substitution of the methionine at the first position of the sequence with a leucine or a valine.

The salicylate monooxygenase can comprise an amino acid sequence having at least 75% identity to SEQ ID NO: 21, 251-258, and 300-305, wherein the amino acid sequence comprises a substitution of the methionine at the first position of the sequence with a leucine or a valine.

The salicylate monooxygenase can comprise an amino acid sequence having at least 80% identity to SEQ ID NO: 21, 251-258, and 300-305, wherein the amino acid sequence comprises a substitution of the methionine at the first position of the sequence with a leucine or a valine.

The salicylate monooxygenase can comprise an amino acid sequence having at least 85% identity to SEQ ID NO: 21, 251-258, and 300-305, wherein the amino acid sequence comprises a substitution of the methionine at the first position of the sequence with a leucine or a valine.

The salicylate monooxygenase can comprise an amino acid sequence having at least 90% identity to SEQ ID NO: 21, 251-258, and 300-305, wherein the amino acid sequence comprises a substitution of the methionine at the first position of the sequence with a leucine or a valine.

The salicylate monooxygenase can comprise an amino acid sequence having at least 95% identity to SEQ ID NO: 21, 251-258, and 300-305, wherein the amino acid sequence comprises a substitution of the methionine at the first position of the sequence with a leucine or a valine.

The salicylate monooxygenase can comprise an amino acid sequence having at least 98% identity to SEQ ID NO: 21, 251-258, and 300-305, wherein the amino acid sequence comprises a substitution of the methionine at the first position of the sequence with a leucine or a valine.

The salicylate monooxygenase can comprise an amino acid sequence having at least 99% identity to SEQ ID NO: 21, 251-258, and 300-305, wherein the amino acid sequence comprises a substitution of the methionine at the first position of the sequence with a leucine or a valine.

Where the monooxygenase comprises a hydroxybenzoate monooxygenase, the hydroxybenzoate monooxygenase can comprise an amino acid sequence having at least 70% identity to any one of SEQ ID NOs. 40, 51-70, and 261.

The hydroxybenzoate monooxygenase can comprise an amino acid sequence having at least 75% identity to any one of SEQ ID NOs. 40, 51-70, and 261.

The hydroxybenzoate monooxygenase can comprise an amino acid sequence having at least 80% identity to any one of SEQ ID NOs. 40, 51-70, and 261.

The hydroxybenzoate monooxygenase can comprise an amino acid sequence having at least 85% identity to any one of SEQ ID NOs. 40, 51-70, and 261.

The hydroxybenzoate monooxygenase can comprise an amino acid sequence having at least 90% identity to any one of SEQ ID NOs. 40, 51-70, and 261.

The hydroxybenzoate monooxygenase can comprise an amino acid sequence having at least 95% identity to any one of SEQ ID NOs. 40, 51-70, and 261.

The hydroxybenzoate monooxygenase can comprise an amino acid sequence having at least 98% identity to any one of SEQ ID NOs. 40, 51-70, and 261.

The hydroxybenzoate monooxygenase can comprise an amino acid sequence having at least 99% identity to any one of SEQ ID NOs. 40, 51-70, and 261.

The hydroxybenzoate monooxygenase can comprise an amino acid sequence having 100% identity to any one of SEQ ID NOs. 40, 51-70, and 261.

The hydroxybenzoate monooxygenase can comprise an amino acid sequence having at least 70% identity to SEQ ID NO: 40 or 261.

The hydroxybenzoate monooxygenase can comprise an amino acid sequence having at least 75% identity to SEQ ID NO: 40 or 261.

The hydroxybenzoate monooxygenase can comprise an amino acid sequence having at least 80% identity to SEQ ID NO: 40 or 261.

The hydroxybenzoate monooxygenase can comprise an amino acid sequence having at least 85% identity to SEQ ID NO: 40 or 261.

The hydroxybenzoate monooxygenase can comprise an amino acid sequence having at least 90% identity to SEQ ID NO: 40 or 261.

The hydroxybenzoate monooxygenase can comprise an amino acid sequence having at least 95% identity to SEQ ID NO: 40 or 261.

The hydroxybenzoate monooxygenase can comprise an amino acid sequence having at least 98% identity to SEQ ID NO: 40 or 261.

The hydroxybenzoate monooxygenase can comprise an amino acid sequence having at least 99% identity to SEQ ID NO: 40 or 261.

The hydroxybenzoate monooxygenase can comprise an amino acid sequence having 100% identity to SEQ ID NO: 40 or 261.

The hydroxybenzoate monooxygenase can comprise an amino acid sequence having at least 70% identity to SEQ ID NO: 40 or 261, wherein the amino acid sequence comprises a substitution of the valine at the first position of the sequence with a leucine.

The hydroxybenzoate monooxygenase can comprise an amino acid sequence having at least 75% identity to SEQ ID NO: 40 or 261, wherein the amino acid sequence comprises a substitution of the valine at the first position of the sequence with a leucine.

The hydroxybenzoate monooxygenase can comprise an amino acid sequence having at least 80% identity to SEQ ID NO: 40 or 261, wherein the amino acid sequence comprises a substitution of the valine at the first position of the sequence with a leucine.

The hydroxybenzoate monooxygenase can comprise an amino acid sequence having at least 85% identity to SEQ ID NO: 40 or 261, wherein the amino acid sequence comprises a substitution of the valine at the first position of the sequence with a leucine.

The hydroxybenzoate monooxygenase can comprise an amino acid sequence having at least 90% identity to SEQ ID NO: 40 or 261, wherein the amino acid sequence comprises a substitution of the valine at the first position of the sequence with a leucine.

The hydroxybenzoate monooxygenase can comprise an amino acid sequence having at least 95% identity to SEQ ID NO: 40 or 261, wherein the amino acid sequence comprises a substitution of the valine at the first position of the sequence with a leucine.

The hydroxybenzoate monooxygenase can comprise an amino acid sequence having at least 98% identity to SEQ ID NO: 40 or 261, wherein the amino acid sequence comprises a substitution of the valine at the first position of the sequence with a leucine.

The hydroxybenzoate monooxygenase can comprise an amino acid sequence having at least 99% identity to SEQ ID NO: 40 or 261, wherein the amino acid sequence comprises a substitution of the valine at the first position of the sequence with a leucine.

The hydroxybenzoate monooxygenase can comprise an amino acid sequence having 100% identity to SEQ ID NO: 40 or 261, wherein the amino acid sequence comprises a substitution of the valine at the first position of the sequence with a leucine.

Where the monooxygenase comprises a hydroxyphenylacetate monooxygenase, the hydroxyphenylacetate monooxygenase can comprise an amino acid sequence having at least 70% identity to SEQ ID NO: 30, 71, or 262.

The hydroxyphenylacetate monooxygenase can comprise an amino acid sequence having at least 75% identity to SEQ ID NO: 30, 71, or 262.

The hydroxyphenylacetate monooxygenase can comprise an amino acid sequence having at least 80% identity to SEQ ID NO: 30, 71, or 262.

The hydroxyphenylacetate monooxygenase can comprise an amino acid sequence having at least 85% identity to SEQ ID NO: 30, 71, or 262.

The hydroxyphenylacetate monooxygenase can comprise an amino acid sequence having at least 90% identity to SEQ ID NO: 30, 71, or 262.

The hydroxyphenylacetate monooxygenase can comprise an amino acid sequence having at least 95% identity to SEQ ID NO: 30, 71, or 262.

The hydroxyphenylacetate monooxygenase can comprise an amino acid sequence having at least 98% identity to SEQ ID NO: 30, 71, or 262.

The hydroxyphenylacetate monooxygenase can comprise an amino acid sequence having at least 99% identity to SEQ ID NO: 30, 71, or 262.

The hydroxyphenylacetate monooxygenase can comprise an amino acid sequence having 100% identity to SEQ ID NO: 30, 71, or 262.

The hydroxyphenylacetate monooxygenase can comprise an amino acid sequence having at least 70% identity to SEQ ID NO: 30 or 262.

The hydroxyphenylacetate monooxygenase can comprise an amino acid sequence having at least 75% identity to SEQ ID NO: 30 or 262.

The hydroxyphenylacetate monooxygenase can comprise an amino acid sequence having at least 80% identity to SEQ ID NO: 30 or 262.

The hydroxyphenylacetate monooxygenase can comprise an amino acid sequence having at least 85% identity to SEQ ID NO: 30 or 262.

The hydroxyphenylacetate monooxygenase can comprise an amino acid sequence having at least 90% identity to SEQ ID NO: 30 or 262.

The hydroxyphenylacetate monooxygenase can comprise an amino acid sequence having at least 95% identity to SEQ ID NO: 30 or 262.

The hydroxyphenylacetate monooxygenase can comprise an amino acid sequence having at least 98% identity to SEQ ID NO: 30 or 262.

The hydroxyphenylacetate monooxygenase can comprise an amino acid sequence having at least 99% identity to SEQ ID NO: 30 or 262.

The hydroxyphenylacetate monooxygenase can comprise an amino acid sequence having 100% identity to SEQ ID NO: 30 or 262.

The hydroxyphenylacetate monooxygenase can comprise an amino acid sequence having at least 70% identity to SEQ ID NO: 30, wherein the amino acid sequence comprises a substitution of the methionine at the first position of the sequence with a leucine or valine.

The hydroxyphenylacetate monooxygenase can comprise an amino acid sequence having at least 75% identity to SEQ ID NO: 30, wherein the amino acid sequence comprises a substitution of the methionine at the first position of the sequence with a leucine or valine.

The hydroxyphenylacetate monooxygenase can comprise an amino acid sequence having at least 80% identity to SEQ ID NO: 30, wherein the amino acid sequence comprises a substitution of the methionine at the first position of the sequence with a leucine or valine.

The hydroxyphenylacetate monooxygenase can comprise an amino acid sequence having at least 85% identity to SEQ ID NO: 30, wherein the amino acid sequence comprises a substitution of the methionine at the first position of the sequence with a leucine or valine.

The hydroxyphenylacetate monooxygenase can comprise an amino acid sequence having at least 90% identity to SEQ ID NO: 30, wherein the amino acid sequence comprises a substitution of the methionine at the first position of the sequence with a leucine or valine.

The hydroxyphenylacetate monooxygenase can comprise an amino acid sequence having at least 95% identity to SEQ ID NO: 30, wherein the amino acid sequence comprises a substitution of the methionine at the first position of the sequence with a leucine or valine.

The hydroxyphenylacetate monooxygenase can comprise an amino acid sequence having at least 98% identity to SEQ ID NO: 30, wherein the amino acid sequence comprises a substitution of the methionine at the first position of the sequence with a leucine or valine.

The hydroxyphenylacetate monooxygenase can comprise an amino acid sequence having at least 99% identity to SEQ ID NO: 30, wherein the amino acid sequence comprises a substitution of the methionine at the first position of the sequence with a leucine or valine.

The hydroxyphenylacetate monooxygenase can comprise an amino acid sequence having 100% identity to SEQ ID NO: 30, wherein the amino acid sequence comprises a substitution of the methionine at the first position of the sequence with a leucine or valine.

In any of the composition, treated seeds, or methods described herein, the enzyme can comprise a phenolic acid decarboxylase.

For example, the phenolic acid decarboxylase can comprise a *Bacillus* phenolic acid decarboxylase (e.g., a *Bacillus mycoides* phenolic acid decarboxylase).

The phenolic acid decarboxylase can comprise an amino acid sequence having at least 70% identity to SEQ ID NO: 73.

The phenolic acid decarboxylase can comprise an amino acid sequence having at least 75% identity to SEQ ID NO: 73.

The phenolic acid decarboxylase can comprise an amino acid sequence having at least 80% identity to SEQ ID NO: 73.

The phenolic acid decarboxylase can comprise an amino acid sequence having at least 85% identity to SEQ ID NO: 73.

The phenolic acid decarboxylase can comprise an amino acid sequence having at least 90% identity to SEQ ID NO: 73.

The phenolic acid decarboxylase can comprise an amino acid sequence having at least 95% identity to SEQ ID NO: 73.

The phenolic acid decarboxylase can comprise an amino acid sequence having at least 98% identity to SEQ ID NO: 73.

The phenolic acid decarboxylase can comprise an amino acid sequence having at least 99% identity to SEQ ID NO: 73.

The phenolic acid decarboxylase can comprise an amino acid sequence having 100% identity to SEQ ID NO: 73.

The phenolic acid decarboxylase can comprise an amino acid sequence having at least 70% identity to SEQ ID NO: 73, wherein the amino acid sequence comprises a substitution of the methionine at the first position of the sequence with a leucine or a valine.

The phenolic acid decarboxylase can comprise an amino acid sequence having at least 75% identity to SEQ ID NO: 73, wherein the amino acid sequence comprises a substitution of the methionine at the first position of the sequence with a leucine or a valine.

The phenolic acid decarboxylase can comprise an amino acid sequence having at least 80% identity to SEQ ID NO: 73, wherein the amino acid sequence comprises a substitution of the methionine at the first position of the sequence with a leucine or a valine.

The phenolic acid decarboxylase can comprise an amino acid sequence having at least 85% identity to SEQ ID NO: 73, wherein the amino acid sequence comprises a substitution of the methionine at the first position of the sequence with a leucine or a valine.

The phenolic acid decarboxylase can comprise an amino acid sequence having at least 90% identity to SEQ ID NO: 73, wherein the amino acid sequence comprises a substitution of the methionine at the first position of the sequence with a leucine or a valine.

The phenolic acid decarboxylase can comprise an amino acid sequence having at least 95% identity to SEQ ID NO: 73, wherein the amino acid sequence comprises a substitution of the methionine at the first position of the sequence with a leucine or a valine.

The phenolic acid decarboxylase can comprise an amino acid sequence having at least 98% identity to SEQ ID NO: 73, wherein the amino acid sequence comprises a substitution of the methionine at the first position of the sequence with a leucine or a valine.

The phenolic acid decarboxylase can comprise an amino acid sequence having at least 99% identity to SEQ ID NO: 73, wherein the amino acid sequence comprises a substitution of the methionine at the first position of the sequence with a leucine or a valine.

In any of the composition, treated seeds, or methods described herein, the enzyme can comprise a chlorohydrolase (e.g., a *Bradyrhizobiaceae* or *Pseudomonas* chlorohydrolase).

The chlorohydrolase can comprise an amino acid sequence having at least 70% identity to any one of SEQ ID NOs. 126-178.

The chlorohydrolase can comprise an amino acid sequence having at least 75% identity to any one of SEQ ID NOs. 126-178.

The chlorohydrolase can comprise an amino acid sequence having at least 80% identity to any one of SEQ ID NOs. 126-178.

The chlorohydrolase can comprise an amino acid sequence having at least 85% identity to any one of SEQ ID NOs. 126-178.

The chlorohydrolase can comprise an amino acid sequence having at least 90% identity to any one of SEQ ID NOs. 126-178.

The chlorohydrolase can comprise an amino acid sequence having at least 95% identity to any one of SEQ ID NOs. 126-178.

The chlorohydrolase can comprise an amino acid sequence having at least 98% identity to any one of SEQ ID NOs. 126-178.

The chlorohydrolase can comprise an amino acid sequence having at least 99% identity to any one of SEQ ID NOs. 126-178.

The chlorohydrolase can comprise an amino acid sequence having 100% identity to any one of SEQ ID NOs. 126-178.

The chlorohydrolase can comprise an amino acid sequence having at least 70% identity to any one of SEQ ID NOs. 126-138 and 140-178, wherein the amino acid sequence comprises a substitution of the methionine at the first position of the sequence with a valine.

The chlorohydrolase can comprise an amino acid sequence having at least 75% identity to any one of SEQ ID NOs. 126-138 and 140-178, wherein the amino acid sequence comprises a substitution of the methionine at the first position of the sequence with a valine.

The chlorohydrolase can comprise an amino acid sequence having at least 80% identity to any one of SEQ ID NOs. 126-138 and 140-178, wherein the amino acid sequence comprises a substitution of the methionine at the first position of the sequence with a valine.

The chlorohydrolase can comprise an amino acid sequence having at least 85% identity to any one of SEQ ID NOs. 126-138 and 140-178, wherein the amino acid sequence comprises a substitution of the methionine at the first position of the sequence with a valine.

The chlorohydrolase can comprise an amino acid sequence having at least 90% identity to any one of SEQ ID NOs. 126-138 and 140-178, wherein the amino acid sequence comprises a substitution of the methionine at the first position of the sequence with a valine.

The chlorohydrolase can comprise an amino acid sequence having at least 95% identity to any one of SEQ ID NOs. 126-138 and 140-178, wherein the amino acid sequence comprises a substitution of the methionine at the first position of the sequence with a valine.

The chlorohydrolase can comprise an amino acid sequence having at least 98% identity to any one of SEQ ID NOs. 126-138 and 140-178, wherein the amino acid sequence comprises a substitution of the methionine at the first position of the sequence with a valine.

The chlorohydrolase can comprise an amino acid sequence having at least 99% identity to any one of SEQ ID NOs. 126-138 and 140-178, wherein the amino acid sequence comprises a substitution of the methionine at the first position of the sequence with a valine.

The chlorohydrolase can comprise an amino acid sequence having at least 70% identity to any one of SEQ ID NOs. 126-132, 134, 136, 137, 140-143, 146-157, 159, 160, and 162-178, wherein the amino acid sequence comprises a substitution of the methionine at the first position of the sequence with a leucine.

The chlorohydrolase can comprise an amino acid sequence having at least 75% identity to any one of SEQ ID NOs. 126-132, 134, 136, 137, 140-143, 146-157, 159, 160, and 162-178, wherein the amino acid sequence comprises a substitution of the methionine at the first position of the sequence with a leucine.

The chlorohydrolase can comprise an amino acid sequence having at least 80% identity to any one of SEQ ID NOs. 126-132, 134, 136, 137, 140-143, 146-157, 159, 160, and 162-178, wherein the amino acid sequence comprises a substitution of the methionine at the first position of the sequence with a leucine.

The chlorohydrolase can comprise an amino acid sequence having at least 85% identity to any one of SEQ ID NOs. 126-132, 134, 136, 137, 140-143, 146-157, 159, 160, and 162-178, wherein the amino acid sequence comprises a substitution of the methionine at the first position of the sequence with a leucine.

The chlorohydrolase can comprise an amino acid sequence having at least 90% identity to any one of SEQ ID NOs. 126-132, 134, 136, 137, 140-143, 146-157, 159, 160, and 162-178, wherein the amino acid sequence comprises a substitution of the methionine at the first position of the sequence with a leucine.

The chlorohydrolase can comprise an amino acid sequence having at least 95% identity to any one of SEQ ID NOs. 126-132, 134, 136, 137, 140-143, 146-157, 159, 160, and 162-178, wherein the amino acid sequence comprises a substitution of the methionine at the first position of the sequence with a leucine.

The chlorohydrolase can comprise an amino acid sequence having at least 98% identity to any one of SEQ ID NOs. 126-132, 134, 136, 137, 140-143, 146-157, 159, 160, and 162-178, wherein the amino acid sequence comprises a substitution of the methionine at the first position of the sequence with a leucine.

The chlorohydrolase can comprise an amino acid sequence having at least 99% identity to any one of SEQ ID NOs. 126-132, 134, 136, 137, 140-143, 146-157, 159, 160, and 162-178, wherein the amino acid sequence comprises a substitution of the methionine at the first position of the sequence with a leucine.

The chlorohydrolase can comprise an amino acid sequence having at least 70%, at least 75%, at least 80%, at least 85%, at least 90%, at least 95%, at least 98%, or at least 99% identity to SEQ ID NO: 139, wherein the amino acid sequence comprises a substitution of the leucine at the first position of the sequence with a methionine or valine.

Where the enzyme comprises a chlorohydrolase, the chlorohydrolase can comprise a chlorothalonil dehalogenase, a chloronicotinic acid chlorohydrolase, or a combination thereof.

For example, the chlorothalonil dehalogenase can comprise an amino acid sequence having at least 70% identity to SEQ ID NO: 168 or 169.

The chlorothalonil dehalogenase can comprise an amino acid sequence having at least 75% identity to SEQ ID NO: 168 or 169.

The chlorothalonil dehalogenase can comprise an amino acid sequence having at least 80% identity to SEQ ID NO: 168 or 169.

The chlorothalonil dehalogenase can comprise an amino acid sequence having at least 85% identity to SEQ ID NO: 168 or 169.

The chlorothalonil dehalogenase can comprise an amino acid sequence having at least 90% identity to SEQ ID NO: 168 or 169.

The chlorothalonil dehalogenase can comprise an amino acid sequence having at least 95% identity to SEQ ID NO: 168 or 169.

The chlorothalonil dehalogenase can comprise an amino acid sequence having at least 98% identity to SEQ ID NO: 168 or 169.

The chlorothalonil dehalogenase can comprise an amino acid sequence having at least 99% identity to SEQ ID NO: 168 or 169.

The chlorothalonil dehalogenase can comprise an amino acid sequence having 100% identity to SEQ ID NO: 168 or 169.

The chlorothalonil dehalogenase can comprise an amino acid sequence having at least 70% identity to SEQ ID NO: 168 or 169, wherein the amino acid sequence comprises a substitution of the methionine at the first position of the sequence with a leucine or a valine.

The chlorothalonil dehalogenase can comprise an amino acid sequence having at least 75% identity to SEQ ID NO: 168 or 169, wherein the amino acid sequence comprises a substitution of the methionine at the first position of the sequence with a leucine or a valine.

The chlorothalonil dehalogenase can comprise an amino acid sequence having at least 80% identity to SEQ ID NO: 168 or 169, wherein the amino acid sequence comprises a substitution of the methionine at the first position of the sequence with a leucine or a valine.

The chlorothalonil dehalogenase can comprise an amino acid sequence having at least 85% identity to SEQ ID NO: 168 or 169, wherein the amino acid sequence comprises a substitution of the methionine at the first position of the sequence with a leucine or a valine.

The chlorothalonil dehalogenase can comprise an amino acid sequence having at least 90% identity to SEQ ID NO: 168 or 169, wherein the amino acid sequence comprises a substitution of the methionine at the first position of the sequence with a leucine or a valine.

The chlorothalonil dehalogenase can comprise an amino acid sequence having at least 95% identity to SEQ ID NO: 168 or 169, wherein the amino acid sequence comprises a substitution of the methionine at the first position of the sequence with a leucine or a valine.

The chlorothalonil dehalogenase can comprise an amino acid sequence having at least 98% identity to SEQ ID NO: 168 or 169, wherein the amino acid sequence comprises a substitution of the methionine at the first position of the sequence with a leucine or a valine.

The chlorothalonil dehalogenase can comprise an amino acid sequence having at least 99% identity to SEQ ID NO: 168 or 169, wherein the amino acid sequence comprises a substitution of the methionine at the first position of the sequence with a leucine or a valine.

Where the chlorohydrolase comprises a chloronicotinic acid chlorohydrolase, the chloronicotinic acid chlorohydrolase can comprise an amino acid sequence having at least 70% identity to SEQ ID NO: 167.

The chloronicotinic acid chlorohydrolase can comprise an amino acid sequence having at least 75% identity to SEQ ID NO: 167.

The chloronicotinic acid chlorohydrolase can comprise an amino acid sequence having at least 80% identity to SEQ ID NO: 167.

The chloronicotinic acid chlorohydrolase can comprise an amino acid sequence having at least 85% identity to SEQ ID NO: 167.

The chloronicotinic acid chlorohydrolase can comprise an amino acid sequence having at least 90% identity to SEQ ID NO: 167.

The chloronicotinic acid chlorohydrolase can comprise an amino acid sequence having at least 95% identity to SEQ ID NO: 167.

The chloronicotinic acid chlorohydrolase can comprise an amino acid sequence having at least 98% identity to SEQ ID NO: 167.

The chloronicotinic acid chlorohydrolase can comprise an amino acid sequence having at least 99% identity to SEQ ID NO: 167.

The chloronicotinic acid chlorohydrolase can comprise an amino acid sequence having 100% identity to SEQ ID NO: 167.

The chloronicotinic acid chlorohydrolase can comprise an amino acid sequence having at least 70% identity to SEQ ID NO: 167, wherein the amino acid sequence comprises a substitution of the methionine at the first position of the sequence with a leucine or a valine.

The chloronicotinic acid chlorohydrolase can comprise an amino acid sequence having at least 75% identity to SEQ ID NO: 167, wherein the amino acid sequence comprises a substitution of the methionine at the first position of the sequence with a leucine or a valine.

The chloronicotinic acid chlorohydrolase can comprise an amino acid sequence having at least 80% identity to SEQ ID NO: 167, wherein the amino acid sequence comprises a substitution of the methionine at the first position of the sequence with a leucine or a valine.

The chloronicotinic acid chlorohydrolase can comprise an amino acid sequence having at least 85% identity to SEQ ID NO: 167, wherein the amino acid sequence comprises a substitution of the methionine at the first position of the sequence with a leucine or a valine.

The chloronicotinic acid chlorohydrolase can comprise an amino acid sequence having at least 90% identity to SEQ ID NO: 167, wherein the amino acid sequence comprises a substitution of the methionine at the first position of the sequence with a leucine or a valine.

The chloronicotinic acid chlorohydrolase can comprise an amino acid sequence having at least 95% identity to SEQ ID NO: 167, wherein the amino acid sequence comprises a substitution of the methionine at the first position of the sequence with a leucine or a valine.

The chloronicotinic acid chlorohydrolase can comprise an amino acid sequence having at least 98% identity to SEQ ID NO: 167, wherein the amino acid sequence comprises a substitution of the methionine at the first position of the sequence with a leucine or a valine.

The chloronicotinic acid chlorohydrolase can comprise an amino acid sequence having at least 99% identity to SEQ ID NO: 167, wherein the amino acid sequence comprises a substitution of the methionine at the first position of the sequence with a leucine or a valine.

Any of the enzymes described herein preferably selectively detoxify at least one auxin herbicide.

Any of the enzymes described herein preferably selectively degrade at least one auxin plant growth regulator.

For any of the enzymes described herein, the enzyme can be in the form of a crude cell extract containing the enzyme or can comprise a partially purified or substantially purified enzyme.

Any of the enzymes described herein can comprise a free enzyme.

For any of the enzymes described herein, the enzyme preferably does not comprise enzyme bound to the exosporium of a *Bacillus cereus* family member.

For any of the enzymes described herein, the enzyme preferably does not comprise enzyme bound to exosporium of an intact *Bacillus cereus* family member spore.

For any of the enzymes described herein, the enzyme is preferably not part of a fusion protein.

J. Immobilization of Enzymes

Any of the enzymes described herein can be immobilized on a matrix, support, or particle.

For example, the matrix, support, or particle can comprise charcoal, biochar, nanocarbon, agarose, an alginate, cellulose, a cellulose derivative, perlite, silica, plastic, stainless steel, glass, polystyrene, a ceramic, dolomite, a clay, diatomaceous earth, talc, a polymer, a gum, a water-dispersable material, or a combination of any thereof.

Immobilizing the enzyme on the matrix or support can result in a slower release of the enzyme as compared to the release rate for the same non-immobilized enzyme under the same conditions.

K. Methods for Making Enzymes

Enzymes can be prepared by a number of standard biochemical and molecular biology methods which are generally known in the art. For example, a gene encoding an enzyme can be amplified from chromosomal DNA using the polymerase chain reaction (PCR), and cloned into a suitable vector (e.g., a plasmid vector). The vector suitably comprises a multiple cloning site into which the DNA molecule encoding the fusion protein can be easily inserted. The vector also suitably contains a selectable marker, such as an antibiotic resistance gene, such that microorganisms transformed, transfected, or mated with the vector can be readily identified and isolated. Where the vector is a plasmid, the plasmid suitably also comprises an origin of replication. Alternatively, DNA coding for the enzyme protein can be integrated into the chromosomal DNA of the microorganism host.

The host can then be cultured and enzyme harvested from the cultures. A crude cell extract can be used or the enzyme can be partially or substantially purified using standard biochemical techniques.

Suitable hosts for large-scale production of enzymes include but are not limited to *Bacillus* species (e.g., *Bacillus subtilis, Bacillus licheniformis, Bacillus coagulans, Bacillus megaterium, Bacillus thuringiensis, Bacillus fusiformis, Bacillus cereus*, or *Bacillus mycoides*), *Escherichia coli, Aspergillus niger, Aspergillus oryzae, Streptomyces species, Klebsiella species, Mucor species, Rhizopus species, Mortierella species, Kluyveromyces species, Candida species, Penicillium chrysogenum, Trichoderma* species *Saccharomyces cerevisiae, Pichiapastoris, Hansenula polymorpha, Kluyveromyces lactis, Yarrowia lipolytica, Schizosaccharomyces pombe*, and *Candida utilitis*.

Enzymes can be used as collected from whole fermentation broth, or partially or substantially purified from the fermentation batch culture.

Enzymes can be expressed with a tag (e.g., a polyhistidine (His)) to facilitate purification.

Alternatively, enzymes can be produced by screening microorganisms and selecting microorganisms that express high levels of the enzyme. This can be done by initial selection, enrichment, and/or screening in nutritional media that contains an enzyme substrate as a nutrient source for the microorganisms. Often additional selection is performed using differential nutrition media that has an indicator to demonstrate the enzyme levels and activity of the enzymes produced by the identified microorganisms. These microorganisms can be mutated and screened for isolates that produce enhanced levels of these enzymes. These microorganism can be utilized in large batch and continuous fermentation methods to create and secrete ample quantities of enzymes. Optimization of the fermentation process and conditions can generally increase the output of the microorganisms.

Enzymes can also be produced at high levels using eukaryotic cell lines, many of which can be engineered to secrete high levels of enzymes, with the advantages of different levels of critical posttranslational modifications and reduction in host enzyme production issues. These can also be scalable to larger cell culture production scale vessels and enzymes purified and treated as above. Examples of suitable eukaryotic cell lines for producing enzymes include, but are not limited to: insect cells derived from insects such as *Bombyx mori, Mamestra brassicae, Spodoptera frugiperda, Trichoplusiani,* or *Drosophila melanogaster*; and vertebrate cell lines derived from a vertebrate such as a mouse, rat, hamster, human, or dog.

Other potential sources of enzymes include cell-free protein expression vectors, including those derived from animal, bacterial, fungal, and plant origins.

Transgenic organisms such as plants, rabbit, mice, chicken, or frogs can also be used for the production of recombinant enzymes. For example, plants can be engineered to overexpress enzymes, and the enzymes can then be collected from the plant and purified or used as crude extract. Such production systems allow for low cost expression of the enzymes and provide a source of material to deliver to plants. These methods have the added advantage of being easily scaled up and with minimal effort.

In each of these production systems, the yield and quality of the desired enzymes can be improved through processes of genetic engineering and formulation. For example, genetic engineering could involve creation of high level expression cassettes and production systems, removal of protease and degradative genes from the production microorganism, optimization of the enzyme for heat stability and long term storage stability, and enhancement of the ability of the enzyme or the production microorganism to secrete mature enzyme into the media for ease of collection and use. Additionally, expression strains can be used to induce point mutations that can lead to increased ability to produce adequate or increased levels of enzymes. In some cases, the production microorganism can also be used and delivered to the plant seed, vicinity around the plant, to the plant roots, to the plant foliage, or near the plant to get the desired effect in situ on the plant.

Other sources of enzymes include extraction from animal, plant, insect, seaweed, or other biological extracts. Common sources of industrial scale enzymes created and/or purified in this manner include porcine and bovine internal tissues, such as abomasum, liver, mucosas, pancreas, as well as plant sources such as *Carica papaya*. Another example would be the purification of glucanases from barley.

Many commercial sources of enzymes come from tissues that have high levels of target enzymes that can be used as is or in purified forms for agricultural uses.

II. Compositions of Herbicide-detoxifying Enzymes

A. Compositions Comprising at Least One Herbicide-detoxifying Enzyme

Compositions comprising any of the isolated enzymes described above in Section Sections I.E through I.H are provided.

A composition is provided. The composition comprises a carrier and an enzyme that comprises an amino acid sequence having at least 70% identity to any one of SEQ ID NOs. 21-71, 73, 126-178, 251-258, 261, 262, 268-272, 276-278, 281, 284, and 300-305.

The enzyme can comprise an amino acid sequence having at least 75% identity to any one of SEQ ID NOs. 21-71, 73, 126-178, 251-258, 261, 262, 268-272, 276-278, 281, 284, and 300-305.

The enzyme can comprise an amino acid sequence having at least 80% identity to any one of SEQ ID NOs. 21-71, 73, 126-178, 251-258, 261, 262, 268-272, 276-278, 281, 284, and 300-305.

The enzyme can comprise an amino acid sequence having at least 85% identity to any one of SEQ ID NOs. 21-71, 73, 126-178, 251-258, 261, 262, 268-272, 276-278, 281, 284, and 300-305.

The enzyme can comprise an amino acid sequence having at least 90% identity to any one of SEQ ID NOs. 21-71, 73, 126-178, 251-258, 261, 262, 268-272, 276-278, 281, 284, and 300-305.

The enzyme can comprise an amino acid sequence having at least 95% identity to any one of SEQ ID NOs. 21-71, 73, 126-178, 251-258, 261, 262, 268-272, 276-278, 281, 284, and 300-305.

The enzyme can comprise an amino acid sequence having at least 98% identity to any one of SEQ ID NOs. 21-71, 73, 126-178, 251-258, 261, 262, 268-272, 276-278, 281, 284, and 300-305.

The enzyme can comprise an amino acid sequence having at least 99% identity to any one of SEQ ID NOs. 21-71, 73, 126-178, 251-258, 261, 262, 268-272, 276-278, 281, 284, and 300-305.

The enzyme can comprise an amino acid sequence having 100% identity to any one of SEQ ID NOs. 21-71, 73, 126-178, 251-258, 261, 262, 268-272, 276-278, 281, 284, and 300-305.

For example, the enzyme can comprise an amino acid sequence having at least 70% identity to any one of SEQ ID NOs. 21-71, 251-258, 261, 262, 268-272, and 300-305.

The enzyme can comprise an amino acid sequence having at least 75% identity to any one of SEQ ID NOs. 21-71, 251-258, 261, 262, 268-272, and 300-305.

The enzyme can comprise an amino acid sequence having at least 80% identity to any one of SEQ ID NOs. 21-71, 251-258, 261, 262, 268-272, and 300-305.

The enzyme can comprise an amino acid sequence having at least 85% identity to any one of SEQ ID NOs. 21-71, 251-258, 261, 262, 268-272, and 300-305.

The enzyme can comprise an amino acid sequence having at least 90% identity to any one of SEQ ID NOs. 21-71, 251-258, 261, 262, 268-272, and 300-305.

The enzyme can comprise an amino acid sequence having at least 95% identity to any one of SEQ ID NOs. 21-71, 251-258, 261, 262, 268-272, and 300-305.

The enzyme can comprise an amino acid sequence having at least 98% identity to any one of SEQ ID NOs. 21-71, 251-258, 261, 262, 268-272, and 300-305.

The enzyme can comprise an amino acid sequence having at least 99% identity to any one of SEQ ID NOs. 21-71, 251-258, 261, 262, 268-272, and 300-305.

The enzyme can comprise an amino acid sequence having 100% identity to any one of SEQ ID NOs. 21-71, 251-258, 261, 262, 268-272, and 300-305.

The enzyme can comprise an amino acid sequence having at least 70% identity to any one of SEQ ID NOs. 21-40, 251-258, 261, 262, and 268-272, and 300-305.

The enzyme can comprise an amino acid sequence having at least 75% identity to any one of SEQ ID NOs. 21-40, 251-258, 261, 262, and 268-272, and 300-305.

The enzyme can comprise an amino acid sequence having at least 80% identity to any one of SEQ ID NOs. 21-40, 251-258, 261, 262, and 268-272, and 300-305.

The enzyme can comprise an amino acid sequence having at least 85% identity to any one of SEQ ID NOs. 21-40, 251-258, 261, 262, and 268-272, and 300-305.

The enzyme can comprise an amino acid sequence having at least 90% identity to any one of SEQ ID NOs. 21-40, 251-258, 261, 262, and 268-272, and 300-305.

The enzyme can comprise an amino acid sequence having at least 95% identity to any one of SEQ ID NOs. 21-40, 251-258, 261, 262, and 268-272, and 300-305.

The enzyme can comprise an amino acid sequence having at least 98% identity to any one of SEQ ID NOs. 21-40, 251-258, 261, 262, and 268-272, and 300-305.

The enzyme can comprise an amino acid sequence having at least 99% identity to any one of SEQ ID NOs. 21-40, 251-258, 261, 262, and 268-272, and 300-305.

The enzyme can comprise an amino acid sequence having 100% identity to any one of SEQ ID NOs. 21-40, 251-258, 261, 262, and 268-272, and 300-305.

The enzyme can comprise an amino acid sequence having at least 70% identity to SEQ ID NO: 21, 251, or 258.

The enzyme can comprise an amino acid sequence having at least 75% identity to SEQ ID NO: 21, 251, or 258.

The enzyme can comprise an amino acid sequence having at least 80% identity to SEQ ID NO: 21, 251, or 258.

The enzyme can comprise an amino acid sequence having at least 85% identity to SEQ ID NO: 21, 251, or 258.

The enzyme can comprise an amino acid sequence having at least 90% identity to SEQ ID NO: 21, 251, or 258.

The enzyme can comprise an amino acid sequence having at least 95% identity to SEQ ID NO: 21, 251, or 258.

The enzyme can comprise an amino acid sequence having at least 98% identity to SEQ ID NO: 21, 251, or 258.

The enzyme can comprise an amino acid sequence having at least 99% identity to SEQ ID NO: 21, 251, or 258.

The enzyme can comprise an amino acid sequence having 100% identity to SEQ ID NO: 21, 251, or 258.

The enzyme can comprise an amino acid sequence having at least 70% identity to any one of SEQ ID NOs. 252-257 and 300-305.

The enzyme can comprise an amino acid sequence having at least 75% identity to any one of SEQ ID NOs. 252-257 and 300-305.

The enzyme can comprise an amino acid sequence having at least 80% identity to any one of SEQ ID NOs. 252-257 and 300-305.

The enzyme can comprise an amino acid sequence having at least 85% identity to any one of SEQ ID NOs. 252-257 and 300-305.

The enzyme can comprise an amino acid sequence having at least 90% identity to any one of SEQ ID NOs. 252-257 and 300-305.

The enzyme can comprise an amino acid sequence having at least 95% identity to any one of SEQ ID NOs. 252-257 and 300-305.

The enzyme can comprise an amino acid sequence having at least 98% identity to any one of SEQ ID NOs. 252-257 and 300-305.

The enzyme can comprise an amino acid sequence having at least 99% identity to any one of SEQ ID NOs. 252-257 and 300-305.

The enzyme can comprise an amino acid sequence having 100% identity to any one of SEQ ID NOs. 252-257 and 300-305.

The enzyme can comprise an amino acid sequence having at least 70% identity to SEQ ID NO: 30 or 262.

The enzyme can comprise an amino acid sequence having at least 75% identity to SEQ ID NO: 30 or 262.

The enzyme can comprise an amino acid sequence having at least 80% identity to SEQ ID NO: 30 or 262.

The enzyme can comprise an amino acid sequence having at least 85% identity to SEQ ID NO: 30 or 2620.

The enzyme can comprise an amino acid sequence having at least 90% identity to SEQ ID NO: 30 or 262.

The enzyme can comprise an amino acid sequence having at least 95% identity to SEQ ID NO: 30 or 262.

The enzyme can comprise an amino acid sequence having at least 98% identity to SEQ ID NO: 30 or 262.

The enzyme can comprise an amino acid sequence having at least 99% identity to SEQ ID NO: 30 or 262.

The enzyme can comprise an amino acid sequence having 100% identity to SEQ ID NO: 30 or 262.

The enzyme can comprise an amino acid sequence having at least 70% identity to SEQ ID NO: 40 or 261.

The enzyme can comprise an amino acid sequence having at least 75% identity to SEQ ID NO: 40 or 261.

The enzyme can comprise an amino acid sequence having at least 80% identity to SEQ ID NO: 40 or 261.

The enzyme can comprise an amino acid sequence having at least 85% identity to SEQ ID NO: 40 or 261.

The enzyme can comprise an amino acid sequence having at least 90% identity to SEQ ID NO: 40 or 261.

The enzyme can comprise an amino acid sequence having at least 95% identity to SEQ ID NO: 40 or 261.

The enzyme can comprise an amino acid sequence having at least 98% identity to SEQ ID NO: 40 or 261.

The enzyme can comprise an amino acid sequence having at least 99% identity to SEQ ID NO: 40 or 261.

The enzyme can comprise an amino acid sequence having 100% identity to SEQ ID NO: 40 or 261.

The enzyme can comprise an amino acid sequence having at least 70% identity to SEQ ID NO: 73.

The enzyme can comprise an amino acid sequence having at least 75% identity to SEQ ID NO: 73.

The enzyme can comprise an amino acid sequence having at least 80% identity to SEQ ID NO: 73.

The enzyme can comprise an amino acid sequence having at least 85% identity to SEQ ID NO: 73.

The enzyme can comprise an amino acid sequence having at least 90% identity to SEQ ID NO: 73.

The enzyme can comprise an amino acid sequence having at least 95% identity to SEQ ID NO: 73.

The enzyme can comprise an amino acid sequence having at least 98% identity to SEQ ID NO: 73.

The enzyme can comprise an amino acid sequence having at least 99% identity to SEQ ID NO: 73.

The enzyme can comprise an amino acid sequence having 100% identity to SEQ ID NO: 73.

The enzyme can comprise an amino acid sequence having at least 70% identity to any one of SEQ ID NOs. 126-178.

The enzyme can comprise an amino acid sequence having at least 75% identity to any one of SEQ ID NOs. 126-178.

The enzyme can comprise an amino acid sequence having at least 80% identity to any one of SEQ ID NOs. 126-178.

The enzyme can comprise an amino acid sequence having at least 85% identity to any one of SEQ ID NOs. 126-178.

The enzyme can comprise an amino acid sequence having at least 90% identity to any one of SEQ ID NOs. 126-178.

The enzyme can comprise an amino acid sequence having at least 95% identity to any one of SEQ ID NOs. 126-178.

The enzyme can comprise an amino acid sequence having at least 98% identity to any one of SEQ ID NOs. 126-178.

The enzyme can comprise an amino acid sequence having at least 99% identity to any one of SEQ ID NOs. 126-178.

The enzyme can comprise an amino acid sequence having 100% identity to any one of SEQ ID NOs. 126-178.

For example, the enzyme can comprise an amino acid sequence having at least 70% identity to SEQ ID NO: 167.

The enzyme can comprise an amino acid sequence having at least 75% identity to SEQ ID NO: 167.

The enzyme can comprise an amino acid sequence having at least 80% identity to SEQ ID NO: 167.

The enzyme can comprise an amino acid sequence having at least 85% identity to SEQ ID NO: 167.

The enzyme can comprise an amino acid sequence having at least 90% identity to SEQ ID NO: 167.

The enzyme can comprise an amino acid sequence having at least 95% identity to SEQ ID NO: 167.

The enzyme can comprise an amino acid sequence having at least 98% identity to SEQ ID NO: 167.

The enzyme can comprise an amino acid sequence having at least 99% identity to SEQ ID NO: 167.

The enzyme can comprise an amino acid sequence having 100% identity to SEQ ID NO: 167.

The enzyme can comprise an amino acid sequence having at least 70% identity to SEQ ID NO: 168.

The enzyme can comprise an amino acid sequence having at least 75% identity to SEQ ID NO: 168.

The enzyme can comprise an amino acid sequence having at least 80% identity to SEQ ID NO: 168.

The enzyme can comprise an amino acid sequence having at least 85% identity to SEQ ID NO: 168.

The enzyme can comprise an amino acid sequence having at least 90% identity to SEQ ID NO: 168.

The enzyme can comprise an amino acid sequence having at least 95% identity to SEQ ID NO: 168.

The enzyme can comprise an amino acid sequence having at least 98% identity to SEQ ID NO: 168.

The enzyme can comprise an amino acid sequence having at least 99% identity to SEQ ID NO: 168.

The enzyme can comprise an amino acid sequence having 100% identity to SEQ ID NO: 168.

The enzyme can comprise an amino acid sequence having at least 70% identity to SEQ ID NO: 169.

The enzyme can comprise an amino acid sequence having at least 75% identity to SEQ ID NO: 169.

The enzyme can comprise an amino acid sequence having at least 80% identity to SEQ ID NO: 169.

The enzyme can comprise an amino acid sequence having at least 85% identity to SEQ ID NO: 169.

The enzyme can comprise an amino acid sequence having at least 90% identity to SEQ ID NO: 169.

The enzyme can comprise an amino acid sequence having at least 95% identity to SEQ ID NO: 169.

The enzyme can comprise an amino acid sequence having at least 98% identity to SEQ ID NO: 169.

The enzyme can comprise an amino acid sequence having at least 99% identity to SEQ ID NO: 169.

The enzyme can comprise an amino acid sequence having 100% identity to any one of SEQ ID NOs. 276-278 and 284

The enzyme can comprise an amino acid sequence having at least 70% identity to any one of SEQ ID NOs. 276-278 and 284.

The enzyme can comprise an amino acid sequence having at least 75% identity to any one of SEQ ID NOs. 276-278 and 284.

The enzyme can comprise an amino acid sequence having at least 80% identity to any one of SEQ ID NOs. 276-278 and 284.

The enzyme can comprise an amino acid sequence having at least 85% identity to any one of SEQ ID NOs. 276-278 and 284.

The enzyme can comprise an amino acid sequence having at least 90% identity to any one of SEQ ID NOs. 276-278 and 284.

The enzyme can comprise an amino acid sequence having at least 95% identity to any one of SEQ ID NOs. 276-278 and 284.

The enzyme can comprise an amino acid sequence having at least 98% identity to any one of SEQ ID NOs. 276-278 and 284.

The enzyme can comprise an amino acid sequence having at least 99% identity to any one of SEQ ID NOs. 276-278 and 284.

The enzyme can comprise an amino acid sequence having 100% identity to any one of SEQ ID NOs. 276-278 and 284.

The enzyme can comprise an amino acid sequence having at least 70% identity to SEQ ID NO: 281.

The enzyme can comprise an amino acid sequence having at least 75% identity to SEQ ID NO: 281.

The enzyme can comprise an amino acid sequence having at least 80% identity to SEQ ID NO: 281.

The enzyme can comprise an amino acid sequence having at least 85% identity to SEQ ID NO: 281.

The enzyme can comprise an amino acid sequence having at least 90% identity to SEQ ID NO: 281.

The enzyme can comprise an amino acid sequence having at least 95% identity to SEQ ID NO: 281.

The enzyme can comprise an amino acid sequence having at least 98% identity to SEQ ID NO: 281.

The enzyme can comprise an amino acid sequence having at least 99% identity to SEQ ID NO: 281.

The enzyme can comprise an amino acid sequence having 100% identity to SEQ ID NO: 281.

In any of the compositions, the carrier can comprise an agriculturally acceptable carrier.

B. Compositions Comprising Two or More Detoxifying Enzymes

Compositions that comprise two or more of any of the detoxifying enzymes described herein are provided.

A composition is provided. The composition comprises a carrier. The composition further comprises a first enzyme. The first enzyme can comprise a monooxygenase, a phenolic acid decarboxylase, or a chlorohydrolase. The composition also comprises a second enzyme. The second enzyme can comprise a monooxygenase, a phenolic acid decarboxylase, or a chlorohydrolase. The first enzyme and the second enzyme are different from one another.

For example, the first enzyme can comprise a monooxygenase and the second enzyme can comprise a phenolic acid decarboxylase.

The first enzyme can comprise a monooxygenase and the second enzyme can comprise a chlorohydrolase.

The first enzyme can comprise a first monooxygenase and the second enzyme can comprise a second monooxygenase, the first monooxygenase and the second monooxygenase being different from one another.

The first enzyme can comprise a phenolic acid decarboxylase and the second enzyme can comprise a chlorohydrolase.

The first enzyme can comprise a first phenolic acid decarboxylase and the second enzyme can comprise a second phenolic acid decarboxylase, the first phenolic acid decarboxylase and the second phenolic acid decarboxylase being different from one another.

The first enzyme can comprise a first chlorohydrolase and the second enzyme can comprise a second chlorohydrolase, the first chlorohydrolase and the second chlorohydrolase being different from one another.

For example, the first chlorohydrolase can comprise a chlorothalonil dehalogenase and the second chlorohydrolase can comprise a chloronicotinic acid chlorohydrolase.

Where the first chlorohydrolase comprises a chlorothalonil dehalogenase and the second chlorohydrolase comprises a chloronicotinic acid chlorohydrolase, the chlorothalonil dehalogenase can comprise an amino acid sequence having at least 70% identity to SEQ ID NO: 168 or 169.

The chlorothalonil dehalogenase can comprise an amino acid sequence having at least 75% identity to SEQ ID NO: 168 or 169.

The chlorothalonil dehalogenase can comprise an amino acid sequence having at least 80% identity to SEQ ID NO: 168 or 169.

The chlorothalonil dehalogenase can comprise an amino acid sequence having at least 85% identity to SEQ ID NO: 168 or 169.

The chlorothalonil dehalogenase can comprise an amino acid sequence having at least 90% identity to SEQ ID NO: 168 or 169.

The chlorothalonil dehalogenase can comprise an amino acid sequence having at least 95% identity to SEQ ID NO: 168 or 169.

The chlorothalonil dehalogenase can comprise an amino acid sequence having at least 98% identity to SEQ ID NO: 168 or 169.

The chlorothalonil dehalogenase can comprise an amino acid sequence having at least 99% identity to SEQ ID NO: 168 or 169.

The chlorothalonil dehalogenase can comprise an amino acid sequence having 100% identity to SEQ ID NO: 168 or 169.

Where the first chlorohydrolase comprises a chlorothalonil dehalogenase and the second chlorohydrolase comprises a chloronicotinic acid chlorohydrolase, the chloronicotinic acid chlorohydrolase can comprise an amino acid sequence having at least 70% identity to SEQ ID NO: 167.

The chloronicotinic acid chlorohydrolase can comprise an amino acid sequence having at least 75% identity to SEQ ID NO: 167.

The chloronicotinic acid chlorohydrolase can comprise an amino acid sequence having at least 80% identity to SEQ ID NO: 167.

The chloronicotinic acid chlorohydrolase can comprise an amino acid sequence having at least 85% identity to SEQ ID NO: 167.

The chloronicotinic acid chlorohydrolase can comprise an amino acid sequence having at least 90% identity to SEQ ID NO: 167.

The chloronicotinic acid chlorohydrolase can comprise an amino acid sequence having at least 95% identity to SEQ ID NO: 167.

The chloronicotinic acid chlorohydrolase can comprise an amino acid sequence having at least 98% identity to SEQ ID NO: 167.

The chloronicotinic acid chlorohydrolase can comprise an amino acid sequence having at least 99% identity to SEQ ID NO: 167.

The chloronicotinic acid chlorohydrolase can comprise an amino acid sequence having 100% identity to SEQ ID NO: 167.

For example, the chlorothalonil dehalogenase can comprise SEQ ID NO: 168 or 169 and the chloronicotinic acid chlorohydrolase can comprise SEQ ID NO: 167.

Where the first enzyme or the second enzyme comprises a monooxygenase, the monooxygenase can comprise a salicylate monooxygenase, a hydroxyphenylacetate monooxygenase, or a hydroxybenzoate monooxygenase.

For example, the first enzyme can comprise a salicylate monooxygenase and the second enzyme can comprise a chlorohydrolase.

Where the first enzyme comprises a salicylate monooxygenase and the second enzyme comprises a chlorohydrolase, the salicylate monooxygenase can comprise an amino acid sequence having at least 70% identity to any one of SEQ ID NOs. 21, 251-258, and 300-305.

The salicylate monooxygenase can comprise an amino acid sequence having at least 75% identity to any one of SEQ ID NOs. 21, 251-258, and 300-305.

The salicylate monooxygenase can comprise an amino acid sequence having at least 80% identity to any one of SEQ ID NOs. 21, 251-258, and 300-305.

The salicylate monooxygenase can comprise an amino acid sequence having at least 85% identity to any one of SEQ ID NOs. 21, 251-258, and 300-305.

The salicylate monooxygenase can comprise an amino acid sequence having at least 90% identity to any one of SEQ ID NOs. 21, 251-258, and 300-305.

The salicylate monooxygenase can comprise an amino acid sequence having at least 95% identity to any one of SEQ ID NOs. 21, 251-258, and 300-305.

The salicylate monooxygenase can comprise an amino acid sequence having at least 98% identity to any one of SEQ ID NOs. 21, 251-258, and 300-305.

The salicylate monooxygenase can comprise an amino acid sequence having at least 99% identity to any one of SEQ ID NOs. 21, 251-258, and 300-305.

The salicylate monooxygenase can comprise an amino acid sequence having at 100% identity to any one of SEQ ID NOs. 21, 251-258, and 300-305.

Where the first enzyme comprises a salicylate monooxygenase and the second enzyme comprises a chlorohydrolase, the chlorohydrolase can comprise an amino acid sequence having at least 70% identity to any one of SEQ ID NOs. 167-169.

The chlorohydrolase can comprise an amino acid sequence having at least 75% identity to any one of SEQ ID NOs. 167-169.

The chlorohydrolase can comprise an amino acid sequence having at least 80% identity to any one of SEQ ID NOs. 167-169.

The chlorohydrolase can comprise an amino acid sequence having at least 85% identity to any one of SEQ ID NOs. 167-169.

The chlorohydrolase can comprise an amino acid sequence having at least 90% identity to any one of SEQ ID NOs. 167-169.

The chlorohydrolase can comprise an amino acid sequence having at least 95% identity to any one of SEQ ID NOs. 167-169.

The chlorohydrolase can comprise an amino acid sequence having at least 98% identity to any one of SEQ ID NOs. 167-169.

The chlorohydrolase can comprise an amino acid sequence having at least 99% identity to any one of SEQ ID NOs. 167-169.

The chlorohydrolase can comprise an amino acid sequence having 100% identity to any one of SEQ ID NOs. 167-169.

For example, the chlorohydrolase can comprise an amino acid sequence having
at least 70% identity to SEQ ID NO: 168 or 169.

The chlorohydrolase can comprise an amino acid sequence having at least 75% identity to SEQ ID NO: 168 or 169.

The chlorohydrolase can comprise an amino acid sequence having at least 80% identity to SEQ ID NO: 168 or 169.

The chlorohydrolase can comprise an amino acid sequence having at least 85% identity to SEQ ID NO: 168 or 169.

The chlorohydrolase can comprise an amino acid sequence having at least 90% identity to SEQ ID NO: 168 or 169.

The chlorohydrolase can comprise an amino acid sequence having at least 95% identity to SEQ ID NO: 168 or 169.

The chlorohydrolase can comprise an amino acid sequence having at least 98% identity to SEQ ID NO: 168 or 169.

The chlorohydrolase can comprise an amino acid sequence having at least 99% identity to SEQ ID NO: 168 or 169.

The chlorohydrolase can comprise an amino acid sequence having 100% identity to SEQ ID NO: 168 or 169.

The first enzyme can comprise a phenolic acid decarboxylase and the second enzyme can comprise a chlorohydrolase.

Where the first enzyme comprises a phenolic acid decarboxylase and the second enzyme comprise a chlorohydrolase, the phenolic acid decarboxylase can comprise an amino acid sequence having at least 70% identity to SEQ ID NO: 73.

The phenolic acid decarboxylase can comprise an amino acid sequence having at least 75% identity to SEQ ID NO: 73.

The phenolic acid decarboxylase can comprise an amino acid sequence having at least 80% identity to SEQ ID NO: 73.

The phenolic acid decarboxylase can comprise an amino acid sequence having at least 85% identity to SEQ ID NO: 73.

The phenolic acid decarboxylase can comprise an amino acid sequence having at least 90% identity to SEQ ID NO: 73.

The phenolic acid decarboxylase can comprise an amino acid sequence having at least 95% identity to SEQ ID NO: 73.

The phenolic acid decarboxylase can comprise an amino acid sequence having at least 98% identity to SEQ ID NO: 73.

The phenolic acid decarboxylase can comprise an amino acid sequence having at least 99% identity to SEQ ID NO: 73.

The phenolic acid decarboxylase can comprise an amino acid sequence having 100% identity to SEQ ID NO: 73.

Where the first enzyme comprises a phenolic acid decarboxylase and the second enzyme comprise a chlorohydrolase, the chlorohydrolase can comprise an amino acid sequence having at least 70% identity to any one of SEQ ID NOs. 167-169.

The chlorohydrolase can comprise an amino acid sequence having at least 75% identity to any one of SEQ ID NOs. 167-169.

The chlorohydrolase can comprise an amino acid sequence having at least 80% identity to any one of SEQ ID NOs. 167-169.

The chlorohydrolase can comprise an amino acid sequence having at least 85% identity to any one of SEQ ID NOs. 167-169.

The chlorohydrolase can comprise an amino acid sequence having at least 90% identity to any one of SEQ ID NOs. 167-169.

The chlorohydrolase can comprise an amino acid sequence having at least 95% identity to any one of SEQ ID NOs. 167-169.

The chlorohydrolase can comprise an amino acid sequence having at least 98% identity to any one of SEQ ID NOs. 167-169.

The chlorohydrolase can comprise an amino acid sequence having at least 99% identity to any one of SEQ ID NOs. 167-169.

The chlorohydrolase can comprise an amino acid sequence having 100% identity to any one of SEQ ID NOs. 167-169.

The first enzyme can comprise a first monooxygenase and the second enzyme can comprise a second monooxygenase, the first monooxygenase and the second monooxygenase being different from one another.

In any of the compositions comprising a first enzyme and a second enzyme, the first enzyme and the second enzyme are preferably present in synergistically effective amounts.

Any of the compositions comprising first and second enzymes can further include one or more additional enzymes, e.g., a third enzyme, a fourth enzyme, a fifth enzyme, etc. The additional enzyme(s) can comprise any of the herbicide-detoxifying enzymes described herein.

A further composition is provided, the composition comprising a carrier and a 2,4-D-alpha ketoglutarate dioxygenase enzyme and a hydroxylase enzyme.

The 2,4-D-alpha ketoglutarate dioxygenase enzyme, can comprise an amino acid sequence having at least 70% identity to any one of SEQ ID NOs. 276-278.

The 2,4-D-alpha ketoglutarate dioxygenase can comprise an amino acid sequence having at least 75% identity to any one of SEQ ID NOs. 276-278.

The 2,4-D-alpha ketoglutarate dioxygenase can comprise an amino acid sequence having at least 80% identity to any one of SEQ ID NOs. 276-278.

The 2,4-D-alpha ketoglutarate dioxygenase can comprise an amino acid sequence having at least 85% identity to any one of SEQ ID NOs. 276-278.

The 2,4-D-alpha ketoglutarate dioxygenase can comprise an amino acid sequence having at least 90% identity to any one of SEQ ID NOs. 276-278.

The 2,4-D-alpha ketoglutarate dioxygenase can comprise an amino acid sequence having at least 95% identity to any one of SEQ ID NOs. 276-278.

The 2,4-D-alpha ketoglutarate dioxygenase can comprise an amino acid sequence having at least 98% identity to any one of SEQ ID NOs. 276-278.

The 2,4-D-alpha ketoglutarate dioxygenase can comprise an amino acid sequence having at least 99% identity to any one of SEQ ID NOs. 276-278.

The 2,4-D-alpha ketoglutarate dioxygenase can comprise an amino acid sequence having 100% identity to any one of SEQ ID NOs. 276-278.

The dioxygenase enzyme can comprise an amino acid sequence having at least 70% identity to SEQ ID NO: 276, wherein the alanine residue at position 198 of SEQ ID NO: 276 is replaced with a valine residue.

The dioxygenase enzyme can comprise an amino acid sequence having at least 75% identity to SEQ ID NO: 276, wherein the alanine residue at position 198 of SEQ ID NO: 276 is replaced with a valine residue.

The dioxygenase enzyme can comprise an amino acid sequence having at least 80% identity to SEQ ID NO: 276, wherein the alanine residue at position 198 of SEQ ID NO: 276 is replaced with a valine residue.

The dioxygenase enzyme can comprise an amino acid sequence having at least 85% identity to SEQ ID NO: 276, wherein the alanine residue at position 198 of SEQ ID NO: 276 is replaced with a valine residue.

The dioxygenase enzyme can comprise an amino acid sequence having at least 90% identity to SEQ ID NO: 276, wherein the alanine residue at position 198 of SEQ ID NO: 276 is replaced with a valine residue.

The dioxygenase enzyme can comprise an amino acid sequence having at least 95% identity to SEQ ID NO: 276, wherein the alanine residue at position 198 of SEQ ID NO: 276 is replaced with a valine residue.

The dioxygenase enzyme can comprise an amino acid sequence having at least 98% identity to SEQ ID NO: 276, wherein the alanine residue at position 198 of SEQ ID NO: 276 is replaced with a valine residue.

The dioxygenase enzyme can comprise an amino acid sequence having at least 99% identity to SEQ ID NO: 276, wherein the alanine residue at position 198 of SEQ ID NO: 276 is replaced with a valine residue.

The dioxygenase enzyme can comprise SEQ ID NO: 277.

The hydroxylase enzyme can comprise an amino acid sequence having at least 70% to SEQ 11 NO: 281.

The hydroxylase enzyme can comprise an amino acid sequence having at least 75% to SEQ ID NO: 281.

The hydroxylase enzyme can comprise an amino acid sequence having at least 80% to SEQ ID NO: 281.

The hydroxylase enzyme can comprise an amino acid sequence having at least 85% to SEQ ID NO: 281.

The hydroxylase enzyme can comprise an amino acid sequence having at least 90% to SEQ ID NO: 281.

The hydroxylase enzyme can comprise an amino acid sequence having at least 95% to SEQ ID NO: 281.

The hydroxylase enzyme can comprise an amino acid sequence having at least 98% to SEQ ID NO: 281.

The hydroxylase enzyme can comprise an amino acid sequence having at least 99% to SEQ ID NO: 281.

The hydroxylase enzyme can comprise an amino acid sequence having 100% to SEQ ID NO: 281.

The hydroxylase enzyme can comprise SEQ ID NO: 281.

In any of the compositions, the carrier can comprise an agriculturally acceptable carrier.

C. Compositions Comprising an Herbicide-detoxifying Enzyme and a Pesticide that is not Degraded by the Enzyme Compositions are provided that comprise any of the herbicide-detoxifying enzymes described herein together with a pesticide that the enzyme cannot degrade. Such compositions can be used, for example, to remove residue of a first herbicide that is a substrate for the enzyme (e.g., dicamba) from a spray tank while simultaneously filling the tank with a second herbicide (e.g., glyphosate) that can then be applied from the tank.

A composition is provided. The composition comprises an agriculturally acceptable carrier and an enzyme. The enzyme comprises a monooxygenase, a phenolic acid decarboxylase, a chlorohydrolase, or a combination of any thereof. The composition further comprises a pesticide. The enzyme is not capable of degrading the pesticide.

The pesticide can be any of the pesticides described in Section VIII below.

D. Carriers, Types of Compositions, and Other Composition Components

In any of the compositions described herein, the carrier can comprise an agriculturally acceptable carrier.

The carrier can comprise any ingredients that are common to formulating crop protection chemicals, including, but not limited to, surfactants, metal salts, metal ions, colorants, compatibility agents (e.g., water conditioners), chelating agents, preservatives, buffering agents, spray drift reductions agents, and combinations of any thereof.

The carrier preferably comprises a carrier that is not associated with the enzyme in nature.

The carrier can comprise, for example, a surfactant, a metal salt, a metal ion, or a combination of any thereof.

Surfactants can increase the interaction of enzymes with their substrates, thereby facilitating and/or accelerating the detoxifying reaction.

Metal salts and metal ions can act as enzyme enhancers, accelerating the reaction.

Metal salts or metal ions are particularly suitable as carriers for compositions or seeds described herein comprising a chlorohydrolase. For example, in any of the compositions or seeds, the first enzyme or the second enzyme can comprise a chlorohydrolase and the carrier comprises a metal salt, a metal ion, or a combination thereof.

The chlorohydrolase and the metal ion or metal salt can be present in synergistically effective amounts.

The metal ion can comprise $Fe^{3+}$, $Fe^{2+}$, $Zn^{2+}$, $Mn^{2+}$, $Cu^{2+}$, $Cu^{+}$ or $Mg^{2+}$. The metal salt can comprise $MnSO_4$.

For example, in any of the compositions or seeds herein, the chlorohydrolase can comprise SEQ ID NO: 167 or 169 and wherein the metal salt comprises $MnSO_4$, or wherein the metal ion comprises $Mn^{2+}$.

The carrier can comprise a preservative, a buffering agent, a compatibility agent (e.g., a water conditioner), a spray drift reduction agent, or a combination of any thereof.

Buffering agents comprise weak acids or weak bases and are used to maintain the pH of a solution near a chosen value after the addition of another acid or base. That is, the function of a buffering agent is used to prevent the solution from a rapid change in pH when acids or bases are added to the solution.

Compatibility agents prevent or alleviate compatibility problems that can arise when multiple pesticides are mixed together. Water conditioning agents are substances that reduce hard water conditions in solution, by sequestering hard water cations. Water conditioning agents can reduce the adverse effects of impurities, for example, $Ca^{2+}$, $Mg^{2+}$, $Mn^{2+}$, $Fe^{2+}$, $K^+$, $Na^+$, $Zn^{2+}$, etc. that can be found in water. Specific water conditioning agents include, but are not limited to salts of polyacrylic, hydroxyl carboxylic, and propionic acids, and combinations of any thereof; phosphate ester; and ammonium sulfate; and combinations of any thereof.

The carrier suitably comprises a preservative, a buffering agent, or a combination thereof.

The carrier can provide enhanced stability and/or activity to the enzyme as compared to the stability and/or activity of the enzyme in the absence of the carrier.

Any of the compositions can comprise a dry formulation.

For example, the dry formulation can comprise a tablet or a powder.

To produce the dry formulations, the enzymes can be produced in liquid form and subjected to drying via spray drying, lyophilization, dehydration, or absorption of excess material. The remaining enzyme concentrate can be shaped or pressed into tablet or used as a powder. In addition, dry formulations can be bulked with bulking agents, drying agents, dyes, effervescent and non-effervescent agents, stabilizers, or combinations of any thereof to facilitate tablet formation and enzyme stability. Common bulking agents include lactose, starch, polyethylene glycol, corn starch, and other quick dissolving agents.

Where the composition comprises a tablet or powder, the tablet or powder can comprise an effervescent agent (e.g., a bicarbonate, a carbonate, a tartarate, or a combination of any thereof).

The composition can comprise a seed coating composition.

Where the composition comprises a seed coating composition, the carrier can comprise a seed coating polymer.

In any of the compositions described herein, the composition can further comprise a co-factor regenerating enzyme. The cofactor-regenerating enzyme can comprise any of the cofactor regenerating enzymes described in Section IX below.

Where the composition comprises a cofactor-regenerating enzyme, the composition preferably further comprises a substrate for the cofactor-regenerating enzyme. The substrate for the cofactor-regenerating enzyme can comprise any of the substrates described in Section IX below.

In any of the compositions described herein, the composition can further comprise a colorimetric detection agent. The colorimetric detection agent can comprise any of the colorimetric detection agents described in Section X below.

Where the composition comprises a colorimetric detection agent, the composition can further comprise an additional enzyme that reacts with and causes a color change in the colorimetric detection agent. The additional enzyme can comprise any of the additional enzymes that react with and cause a color change in the colorimetric detection agent described in Section X below.

III. Plant Seeds Treated with Herbicide-detoxifying Enzymes or Compositions Comprising Herbicide-Detoxifying Enzymes The invention also relates to plant seeds treated with any of the detoxifying enzymes or compositions described herein. Where the enzymes or compositions comprising the enzymes are applied to a plant seed, the tolerance of a plant grown from the seed to an auxin herbicide can be enhanced.

A plant seed is provided. The plant seed can be treated with any of the isolated enzymes described above in Sections I.E through I.H.

A plant seed is provided. The plant seed can be treated with any of the compositions described above in Section II.

A further plant seed is provided. The plant seed is treated with at least one enzyme. The enzyme comprising a monooxygenase, a phenolic acid decarboxylase, a chlorohydrolase, or a combination of any thereof.

The plant seed can be treated with a first enzyme and a second enzyme. The first enzyme comprises a monooxygenase, a phenolic acid decarboxylase, or a chlorohydrolase. The second enzyme comprises a monooxygenase, a phenolic acid decarboxylase, or a chlorohydrolase. The first enzyme and the second enzyme are different from one another.

The first enzyme can comprise a first chlorohydrolase and the second enzyme can comprise a second chlorohydrolase. The first chlorohydrolase and the second chlorohydrolase are different from one another.

For example, the first chlorohydrolase can comprise a chlorothalonil dehalogenase and the second chlorohydrolase can comprise a chloronicotinic acid chlorohydrolase.

Where the first chlorohydrolase comprises a chlorothalonil dehalogenase and the second chlorohydrolase comprises a chloronicotinic acid chlorohydrolase, the chlorothalonil dehalogenase can comprise an amino acid sequence having at least 70% identity to SEQ ID NO: 168 or 169.

The chlorothalonil dehalogenase can comprise an amino acid sequence having at least 75% identity to SEQ ID NO: 168 or 169.

The chlorothalonil dehalogenase can comprise an amino acid sequence having at least 80% identity to SEQ ID NO: 168 or 169.

The chlorothalonil dehalogenase can comprise an amino acid sequence having at least 85% identity to SEQ ID NO: 168 or 169.

The chlorothalonil dehalogenase can comprise an amino acid sequence having at least 90% identity to SEQ ID NO: 168 or 169.

The chlorothalonil dehalogenase can comprise an amino acid sequence having at least 95% identity to SEQ ID NO: 168 or 169.

The chlorothalonil dehalogenase can comprise an amino acid sequence having at least 98% identity to SEQ ID NO: 168 or 169.

The chlorothalonil dehalogenase can comprise an amino acid sequence having at least 99% identity to SEQ ID NO: 168 or 169.

The chlorothalonil dehalogenase can comprise an amino acid sequence having 100% identity to SEQ ID NO: 168 or 169.

Where the first chlorohydrolase comprises a chlorothalonil dehalogenase and the second chlorohydrolase comprises a chloronicotinic acid chlorohydrolase, the chloronicotinic acid chlorohydrolase can comprise an amino acid sequence having at least 70% identity to SEQ ID NO: 167.

The chloronicotinic acid chlorohydrolase can comprise an amino acid sequence having at least 75% identity to SEQ ID NO: 167.

The chloronicotinic acid chlorohydrolase can comprise an amino acid sequence having at least 80% identity to SEQ ID NO: 167.

The chloronicotinic acid chlorohydrolase can comprise an amino acid sequence having at least 85% identity to SEQ ID NO: 167.

The chloronicotinic acid chlorohydrolase can comprise an amino acid sequence having at least 90% identity to SEQ ID NO: 167.

The chloronicotinic acid chlorohydrolase can comprise an amino acid sequence having at least 95% identity to SEQ ID NO: 167.

The chloronicotinic acid chlorohydrolase can comprise an amino acid sequence having at least 98% identity to SEQ ID NO: 167.

The chloronicotinic acid chlorohydrolase can comprise an amino acid sequence having at least 99% identity to SEQ ID NO: 167.

The chloronicotinic acid chlorohydrolase can comprise an amino acid sequence having 100% identity to SEQ ID NO: 167.

For example, the chlorothalonil dehalogenase can comprise SEQ ID NO: 168 or 169 and the chloronicotinic acid chlorohydrolase can comprise SEQ ID NO: 167.

Where the first enzyme or the second enzyme comprises a monooxygenase, the monooxygenase can comprise a salicylate monooxygenase, a hydroxyphenylacetate monooxygenase, or a hydroxybenzoate monooxygenase.

For example, the first enzyme can comprise a salicylate monooxygenase and the second enzyme can comprise a chlorohydrolase.

Where the first enzyme comprises a salicylate monooxygenase and the second enzyme comprises a chlorohydrolase, the salicylate monooxygenase can comprise an amino acid sequence having at least 70% identity to SEQ ID NO: any one of SEQ ID NOs. 21, 251-258, and 300-305.

The salicylate monooxygenase can comprise an amino acid sequence having at least 75% identity to SEQ ID NO: any one of SEQ ID NOs. 21, 251-258, and 300-305.

The salicylate monooxygenase can comprise an amino acid sequence having at least 80% identity to SEQ ID NO: any one of SEQ ID NOs. 21, 251-258, and 300-305.

The salicylate monooxygenase can comprise an amino acid sequence having at least 85% identity to SEQ ID NO: any one of SEQ ID NOs. 21, 251-258, and 300-305.

The salicylate monooxygenase can comprise an amino acid sequence having at least 90% identity to SEQ ID NO: any one of SEQ ID NOs. 21, 251-258, and 300-305.

The salicylate monooxygenase can comprise an amino acid sequence having at least 95% identity to SEQ ID NO: any one of SEQ ID NOs. 21, 251-258, and 300-305.

The salicylate monooxygenase can comprise an amino acid sequence having at least 98% identity to SEQ ID NO: any one of SEQ ID NOs. 21, 251-258, and 300-305.

The salicylate monooxygenase can comprise an amino acid sequence having at least 99% identity to SEQ ID NO: any one of SEQ ID NOs. 21, 251-258, and 300-305.

The salicylate monooxygenase can comprise an amino acid sequence having at 100% identity to SEQ ID NO: any one of SEQ ID NOs. 21, 251-258, and 300-305.

Where the first enzyme comprises a salicylate monooxygenase and the second enzyme comprises a chlorohydrolase, the chlorohydrolase can comprise an amino acid sequence having at least 70% identity to any one of SEQ ID NOs. 167-169.

The chlorohydrolase can comprise an amino acid sequence having at least 75% identity to any one of SEQ ID NOs. 167-169.

The chlorohydrolase can comprise an amino acid sequence having at least 80% identity to any one of SEQ ID NOs. 167-169.

The chlorohydrolase can comprise an amino acid sequence having at least 85% identity to any one of SEQ ID NOs. 167-169.

The chlorohydrolase can comprise an amino acid sequence having at least 90% identity to any one of SEQ ID NOs. 167-169.

The chlorohydrolase can comprise an amino acid sequence having at least 95% identity to any one of SEQ ID NOs. 167-169.

The chlorohydrolase can comprise an amino acid sequence having at least 98% identity to any one of SEQ ID NOs. 167-169.

The chlorohydrolase can comprise an amino acid sequence having at least 99% identity to any one of SEQ ID NOs. 167-169.

The chlorohydrolase can comprise an amino acid sequence having 100% identity to any one of SEQ ID NOs. 167-169.

For example, the chlorohydrolase can comprise an amino acid sequence having
at least 70% identity to SEQ ID NO: 168 or 169.

The chlorohydrolase can comprise an amino acid sequence having at least 75% identity to SEQ ID NO: 168 or 169.

The chlorohydrolase can comprise an amino acid sequence having at least 80% identity to SEQ ID NO: 168 or 169.

The chlorohydrolase can comprise an amino acid sequence having at least 85% identity to SEQ ID NO: 168 or 169.

The chlorohydrolase can comprise an amino acid sequence having at least 90% identity to SEQ ID NO: 168 or 169.

The chlorohydrolase can comprise an amino acid sequence having at least 95% identity to SEQ ID NO: 168 or 169.

The chlorohydrolase can comprise an amino acid sequence having at least 98% identity to SEQ ID NO: 168 or 169.

The chlorohydrolase can comprise an amino acid sequence having at least 99% identity to SEQ ID NO: 168 or 169.

The chlorohydrolase can comprise an amino acid sequence having 100% identity to SEQ ID NO: 168 or 169.

The first enzyme can comprise a phenolic acid decarboxylase and the second enzyme can comprise a chlorohydrolase.

Where the first enzyme comprises a phenolic acid decarboxylase and the second enzyme comprise a chlorohydrolase, the phenolic acid decarboxylase can comprise an amino acid sequence having at least 70% identity to SEQ ID NO: 73.

The phenolic acid decarboxylase can comprise an amino acid sequence having at least 75% identity to SEQ ID NO: 73.

The phenolic acid decarboxylase can comprise an amino acid sequence having at least 80% identity to SEQ ID NO: 73.

The phenolic acid decarboxylase can comprise an amino acid sequence having at least 85% identity to SEQ ID NO: 73.

The phenolic acid decarboxylase can comprise an amino acid sequence having at least 90% identity to SEQ ID NO: 73.

The phenolic acid decarboxylase can comprise an amino acid sequence having at least 95% identity to SEQ ID NO: 73.

The phenolic acid decarboxylase can comprise an amino acid sequence having at least 98% identity to SEQ ID NO: 73.

The phenolic acid decarboxylase can comprise an amino acid sequence having at least 99% identity to SEQ ID NO: 73.

The phenolic acid decarboxylase can comprise an amino acid sequence having 100% identity to SEQ ID NO: 73.

Where the first enzyme comprises a phenolic acid decarboxylase and the second enzyme comprise a chlorohydrolase, the chlorohydrolase can comprise an amino acid sequence having at least 70% identity to any one of SEQ ID NOs. 167-169.

The chlorohydrolase can comprise an amino acid sequence having at least 75% identity to any one of SEQ ID NOs. 167-169.

The chlorohydrolase can comprise an amino acid sequence having at least 80% identity to any one of SEQ ID NOs. 167-169.

The chlorohydrolase can comprise an amino acid sequence having at least 85% identity to any one of SEQ ID NOs. 167-169.

The chlorohydrolase can comprise an amino acid sequence having at least 90% identity to any one of SEQ ID NOs. 167-169.

The chlorohydrolase can comprise an amino acid sequence having at least 95% identity to any one of SEQ ID NOs. 167-169.

The chlorohydrolase can comprise an amino acid sequence having at least 98% identity to any one of SEQ ID NOs. 167-169.

The chlorohydrolase can comprise an amino acid sequence having at least 99% identity to any one of SEQ ID NOs. 167-169.

The chlorohydrolase can comprise an amino acid sequence having 100% identity to any one of SEQ ID NOs. 167-169.

The first enzyme can comprise a first monooxygenase and the second enzyme can comprise a second monooxygenase. The first monooxygenase and the second monooxygenase are different from one another.

In any of the seeds treated with a first enzyme and a second enzyme, the first enzyme and the second enzyme are preferably present in synergistically effective amounts.

Any of the seeds treated with first and second enzymes can be further treated with one or more additional enzymes, e.g., a third enzyme, a fourth enzyme, a fifth enzyme, etc. The additional enzyme(s) can comprise any of the herbicide-detoxifying enzymes described herein.

Any of the plant seeds can be coated with the enzyme or enzymes.

For example, any of the plant seeds can be coated with a composition comprising the enzyme or enzymes and an agriculturally acceptable carrier.

IV. Methods for Detoxifying Auxin Herbicides or Degrading Auxin Plant Growth Regulators The herbicide detoxifying enzymes described herein can be used in methods for detoxifying auxin herbicides. The herbicide detoxifying enzymes can also be used in methods for degrading auxin plant growth regulators.

A method for detoxifying an auxin herbicide is provided. The method comprises contacting the auxin herbicide with any of the enzymes described above in Sections I.E through I.H. Alternatively or in addition, the method comprises contacting the auxin herbicide with any of the compositions described above in Section II.

A method for degrading an auxin plant growth regulator is provided. The method comprises contacting the auxin plant growth regulator with any of the enzymes described above in Sections I.E through I.H. Alternatively or in addition, the method comprises contacting the auxin plant growth regulator with any of the compositions described above in Section II.

Another method for detoxifying an auxin herbicide is provided. The method comprises contacting the auxin herbicide with an enzyme. The enzyme can comprise a salicylate monooxygenase; a hydroxyphenylacetate monooxygenase; a hydroxybenzoate monooxygenase; a monooxygenase comprising an amino acid sequence having at least 70%, at least 75%, at least 80%, at least 85%, at least 90%, at least 95%, at least 98%, at least 99%, or 100% identity to any one of SEQ ID NOs. 21-71; a phenolic acid decarboxylase comprising an amino acid sequence having at least 70%, at least 75%, at least 80%, at least 85%, at least 90%, at least 95%, at least 98%, at least 99%, or 100% identity to SEQ ID NO: 73; a chlorohydrolase that is capable of detoxifying the auxin herbicide; or a combination of any thereof.

A further method for degrading an auxin plant growth regulator is also provided. The method comprises contacting the auxin plant growth regulator with an enzyme. The enzyme can comprise a salicylate monooxygenase; a hydroxyphenylacetate monooxygenase; a hydroxybenzoate monooxygenase; a monooxygenase comprising an amino acid sequence having at least 70%, at least 75%, at least 80%, at least 85%, at least 90%, at least 95%, at least 98%, at least 99%, or 100% identity to any one of SEQ ID NOs. 21-71, 251-258, 261, 262, 268-272, and 300-305; a phenolic acid decarboxylase comprising an amino acid sequence having at least 70%, at least 75%, at least 80%, at least 85%, at least 90%, at least 95%, at least 98%, at least 99%, or 100% identity to SEQ ID NO: 73; a chlorohydrolase that is capable of degrading the auxin plant growth regulator; or a combination of any thereof.

Yet another method for detoxifying an auxin herbicide is provided. The method comprises contacting the auxin herbicide with a first enzyme and a second enzyme, the first and second enzymes being different from one another.

A further method for degrading an auxin plant growth regulator is also provided. The method comprises contacting the auxin plant growth regulator with a first enzyme and a second enzyme, the first and second enzymes being different from one another.

Where the method comprises contacting the auxin herbicide or the auxin plant growth regulator with a first enzyme and a second enzyme, the method can comprise sequentially contacting the auxin herbicide or the auxin plant growth regulator with the first enzyme and the second enzyme.

Where the method comprises contacting the auxin herbicide or the auxin plant growth regulator with a first enzyme and a second enzyme, the method can comprise concurrently contacting the auxin herbicide or the auxin plant growth regulator with the first enzyme and the second enzyme.

The first enzyme can comprise a monooxygenase, a phenolic acid decarboxylase, or a chlorohydrolase. The second enzyme can comprise a monooxygenase, a phenolic acid decarboxylase, or a chlorohydrolase.

For example, the first enzyme can comprise a monooxygenase and the second enzyme can comprise a phenolic acid decarboxylase.

The first enzyme can comprise a monooxygenase and the second enzyme can comprise a chlorohydrolase.

The first enzyme can comprise a first monooxygenase and the second enzyme can comprise a second monooxygenase, the first monooxygenase and the second monooxygenase being different from one another.

The first enzyme can comprise a phenolic acid decarboxylase and the second enzyme can comprise a chlorohydrolase.

The first enzyme can comprise a first phenolic acid decarboxylase and the second enzyme can comprise a second phenolic acid decarboxylase, the first phenolic acid decarboxylase and the second phenolic acid decarboxylase being different from one another.

The first enzyme can comprise a first chlorohydrolase and the second enzyme can comprise a second chlorohydrolase, the first chlorohydrolase and the second chlorohydrolase being different from one another.

Where the first enzyme, the second enzyme, or both the first the first enzyme and the second enzyme comprise a monooxygenase, the monooxygenase can comprise a salicylate monooxygenase, a hydroxyphenylacetate monooxygenase, or a hydroxybenzoate monooxygenase.

Where the first enzyme, the second enzyme, or both the first the first enzyme and the second enzyme comprise a monooxygenase, the monooxygenase can comprise a monooxygenase comprising an amino acid sequence having at least 70%, at least 75%, at least 80%, at least 85%, at least 90%, at least 95%, at least 98%, at least 99%, or 100% identity to any one of SEQ ID NOs. 21-71, 251-258, 261, 262, 268-272, and 300-305.

Where the first enzyme, the second enzyme, or both the first enzyme and the second enzyme comprise a phenolic acid decarboxylase, the phenolic acid decarboxylase can comprise an amino acid sequence having at least 70%, at least 75%, at least 80%, at least 85%, at least 90%, at least 95%, at least 98%, at least 99%, or 100% identity to SEQ ID NO: 73.

Where the first enzyme, the second enzyme, or both the first enzyme and the second enzyme comprise a chlorohydrolase, the chlorohydrolase preferably comprises a chlorohydrolase that is capable of detoxifying the auxin herbicide or degrading the auxin plant growth regulator.

In any of the methods involving the use of a chlorohydrolase that is capable of detoxifying the auxin herbicide or degrading the auxin plant growth regulator, the chlorohydrolase can comprise an amino acid sequence having at least 70% identity to any one of SEQ ID NOs. 126-178.

The chlorohydrolase can comprise an amino acid sequence having at least 75% identity to any one of SEQ ID NOs. 126-178.

The chlorohydrolase can comprise an amino acid sequence having at least 80% identity to any one of SEQ ID NOs. 126-178.

The chlorohydrolase can comprise an amino acid sequence having at least 85% identity to any one of SEQ ID NOs. 126-178.

The chlorohydrolase can comprise an amino acid sequence having at least 90% identity to any one of SEQ ID NOs. 126-178.

The chlorohydrolase can comprise an amino acid sequence having at least 95% identity to any one of SEQ ID NOs. 126-178.

The chlorohydrolase can comprise an amino acid sequence having at least 98% identity to any one of SEQ ID NOs. 126-178.

The chlorohydrolase can comprise an amino acid sequence having at least 99% identity to any one of SEQ ID NOs. 126-178.

The chlorohydrolase can comprise an amino acid sequence having 100% identity to any one of SEQ ID NOs. 126-178.

Where the method comprises contacting the auxin herbicide or the auxin plant growth regulator with a first enzyme and a second enzyme, the first enzyme can comprise a first chlorohydrolase and the second enzyme can comprise a second chlorohydrolase, the first chlorohydrolase and the second chlorohydrolase being different from one another.

For example, the first chlorohydrolase can comprise a chlorothalonil dehalogenase and the second chlorohydrolase can comprise a chloronicotinic acid chlorohydrolase.

Where the first chlorohydrolase comprises a chlorothalonil dehalogenase and the second chlorohydrolase comprises a chloronicotinic acid chlorohydrolase, the chlorothalonil dehalogenase can comprise an amino acid sequence having at least 70% identity to SEQ ID NO: 168 or 169.

The chlorothalonil dehalogenase can comprise an amino acid sequence having at least 75% identity to SEQ ID NO: 168 or 169.

The chlorothalonil dehalogenase can comprise an amino acid sequence having at least 80% identity to SEQ ID NO: 168 or 169.

The chlorothalonil dehalogenase can comprise an amino acid sequence having at least 85% identity to SEQ ID NO: 168 or 169.

The chlorothalonil dehalogenase can comprise an amino acid sequence having at least 90% identity to SEQ ID NO: 168 or 169.

The chlorothalonil dehalogenase can comprise an amino acid sequence having at least 95% identity to SEQ ID NO: 168 or 169.

The chlorothalonil dehalogenase can comprise an amino acid sequence having at least 98% identity to SEQ ID NO: 168 or 169.

The chlorothalonil dehalogenase can comprise an amino acid sequence having at least 99% identity to SEQ ID NO: 168 or 169.

The chlorothalonil dehalogenase can comprise an amino acid sequence having 100% identity to SEQ ID NO: 168 or 169.

Where the first chlorohydrolase comprises a chlorothalonil dehalogenase and the second chlorohydrolase comprises a chloronicotinic acid chlorohydrolase, the chloronicotinic acid chlorohydrolase can comprise an amino acid sequence having at least 70% identity to SEQ ID NO: 167.

The chloronicotinic acid chlorohydrolase can comprise an amino acid sequence having at least 75% identity to SEQ ID NO: 167.

The chloronicotinic acid chlorohydrolase can comprise an amino acid sequence having at least 80% identity to SEQ ID NO: 167.

The chloronicotinic acid chlorohydrolase can comprise an amino acid sequence having at least 85% identity to SEQ ID NO: 167.

The chloronicotinic acid chlorohydrolase can comprise an amino acid sequence having at least 90% identity to SEQ ID NO: 167.

The chloronicotinic acid chlorohydrolase can comprise an amino acid sequence having at least 95% identity to SEQ ID NO: 167.

The chloronicotinic acid chlorohydrolase can comprise an amino acid sequence having at least 98% identity to SEQ ID NO: 167.

The chloronicotinic acid chlorohydrolase can comprise an amino acid sequence having at least 99% identity to SEQ ID NO: 167.

The chloronicotinic acid chlorohydrolase can comprise an amino acid sequence having 100% identity to SEQ ID NO: 167.

For example, the chlorothalonil dehalogenase can comprise SEQ ID NO: 168 or 169 and the chloronicotinic acid chlorohydrolase can comprise SEQ ID NO: 167.

Where the method comprises contacting the auxin herbicide or the auxin plant growth regulator with a first enzyme and a second enzyme, the first enzyme or the second enzyme can comprise a monooxygenase. The monooxygenase can comprise a salicylate monooxygenase, a hydroxyphenylacetate monooxygenase, or a hydroxybenzoate monooxygenase.

For example, the first enzyme can comprise a salicylate monooxygenase and the second enzyme can comprise a chlorohydrolase.

Where the first enzyme comprises a salicylate monooxygenase and the second enzyme comprises a chlorohydrolase, the salicylate monooxygenase can comprise an amino acid sequence having at least 70% identity to SEQ ID NO: 21, 251-258, and 300-305.

The salicylate monooxygenase can comprise an amino acid sequence having at least 75% identity to SEQ ID NO: 21, 251-258, and 300-305.

The salicylate monooxygenase can comprise an amino acid sequence having at least 80% identity to SEQ ID NO: 21, 251-258, and 300-305.

The salicylate monooxygenase can comprise an amino acid sequence having at least 85% identity to SEQ ID NO: 21, 251-258, and 300-305.

The salicylate monooxygenase can comprise an amino acid sequence having at least 90% identity to SEQ ID NO: 21, 251-258, and 300-305.

The salicylate monooxygenase can comprise an amino acid sequence having at least 95% identity to SEQ ID NO: 21, 251-258, and 300-305.

The salicylate monooxygenase can comprise an amino acid sequence having at least 98% identity to SEQ ID NO: 21, 251-258, and 300-305.

The salicylate monooxygenase can comprise an amino acid sequence having at least 99% identity to SEQ ID NO: 21, 251-258, and 300-305.

The salicylate monooxygenase can comprise an amino acid sequence having at 100% identity to SEQ ID NO: 21, 251-258, and 300-305.

Where the first enzyme comprises a salicylate monooxygenase and the second enzyme comprises a chlorohydrolase, the chlorohydrolase can comprise an amino acid sequence having at least 70% identity to any one of SEQ ID NOs. 167-169.

The chlorohydrolase can comprise an amino acid sequence having at least 75% identity to any one of SEQ ID NOs. 167-169.

The chlorohydrolase can comprise an amino acid sequence having at least 80% identity to any one of SEQ ID NOs. 167-169.

The chlorohydrolase can comprise an amino acid sequence having at least 85% identity to any one of SEQ ID NOs. 167-169.

The chlorohydrolase can comprise an amino acid sequence having at least 90% identity to any one of SEQ ID NOs. 167-169.

The chlorohydrolase can comprise an amino acid sequence having at least 95% identity to any one of SEQ ID NOs. 167-169.

The chlorohydrolase can comprise an amino acid sequence having at least 98% identity to any one of SEQ ID NOs. 167-169.

The chlorohydrolase can comprise an amino acid sequence having at least 99% identity to any one of SEQ ID NOs. 167-169.

The chlorohydrolase can comprise an amino acid sequence having 100% identity to any one of SEQ ID NOs. 167-169.

For example, the chlorohydrolase can comprise an amino acid sequence having
at least 70% identity to SEQ ID NO: 168 or 169.

The chlorohydrolase can comprise an amino acid sequence having at least 75% identity to SEQ ID NO: 168 or 169.

The chlorohydrolase can comprise an amino acid sequence having at least 80% identity to SEQ ID NO: 168 or 169.

The chlorohydrolase can comprise an amino acid sequence having at least 85% identity to SEQ ID NO: 168 or 169.

The chlorohydrolase can comprise an amino acid sequence having at least 90% identity to SEQ ID NO: 168 or 169.

The chlorohydrolase can comprise an amino acid sequence having at least 95% identity to SEQ ID NO: 168 or 169.

The chlorohydrolase can comprise an amino acid sequence having at least 98% identity to SEQ ID NO: 168 or 169.

The chlorohydrolase can comprise an amino acid sequence having at least 99% identity to SEQ ID NO: 168 or 169.

The chlorohydrolase can comprise an amino acid sequence having 100% identity to SEQ ID NO: 168 or 169.

Where the method comprises contacting the auxin herbicide or the auxin plant growth regulator with a first enzyme and a second enzyme, the first enzyme can comprise a phenolic acid decarboxylase and the second enzyme can comprise a chlorohydrolase.

Where the first enzyme comprises a phenolic acid decarboxylase and the second enzyme comprise a chlorohydrolase, the phenolic acid decarboxylase can comprise an amino acid sequence having at least 70% identity to SEQ ID NO: 73.

The phenolic acid decarboxylase can comprise an amino acid sequence having at least 75% identity to SEQ ID NO: 73.

The phenolic acid decarboxylase can comprise an amino acid sequence having at least 80% identity to SEQ ID NO: 73.

The phenolic acid decarboxylase can comprise an amino acid sequence having at least 85% identity to SEQ ID NO: 73.

The phenolic acid decarboxylase can comprise an amino acid sequence having at least 90% identity to SEQ ID NO: 73.

The phenolic acid decarboxylase can comprise an amino acid sequence having at least 95% identity to SEQ ID NO: 73.

The phenolic acid decarboxylase can comprise an amino acid sequence having at least 98% identity to SEQ ID NO: 73.

The phenolic acid decarboxylase can comprise an amino acid sequence having at least 99% identity to SEQ ID NO: 73.

The phenolic acid decarboxylase can comprise an amino acid sequence having 100% identity to SEQ ID NO: 73.

Where the first enzyme comprises a phenolic acid decarboxylase and the second enzyme comprise a chlorohydrolase, the chlorohydrolase can comprise an amino acid sequence having at least 70% identity to any one of SEQ ID NOs. 167-169.

The chlorohydrolase can comprise an amino acid sequence having at least 75% identity to any one of SEQ ID NOs. 167-169.

The chlorohydrolase can comprise an amino acid sequence having at least 80% identity to any one of SEQ ID NOs. 167-169.

The chlorohydrolase can comprise an amino acid sequence having at least 85% identity to any one of SEQ ID NOs. 167-169.

The chlorohydrolase can comprise an amino acid sequence having at least 90% identity to any one of SEQ ID NOs. 167-169.

The chlorohydrolase can comprise an amino acid sequence having at least 95% identity to any one of SEQ ID NOs. 167-169.

The chlorohydrolase can comprise an amino acid sequence having at least 98% identity to any one of SEQ ID NOs. 167-169.

The chlorohydrolase can comprise an amino acid sequence having at least 99% identity to any one of SEQ ID NOs. 167-169.

The chlorohydrolase can comprise an amino acid sequence having 100% identity to any one of SEQ ID NOs. 167-169.

Where the method comprises contacting the auxin herbicide or the auxin plant growth regulator with a first enzyme and a second enzyme, the first enzyme can comprise a first monooxygenase and the second enzyme can comprise a second monooxygenase, the first monooxygenase and the second monooxygenase being different from one another.

In any of the methods comprising contacting the auxin herbicide or the auxin plant growth regulator with a first enzyme and a second enzyme, the first enzyme and the second enzyme are preferably present in synergistically effective amounts.

Any methods comprising contacting the auxin herbicide or the auxin plant growth regulator with a first enzyme and a second enzyme can further comprise contacting the auxin herbicide or the auxin plant growth regulator with one or more additional enzymes, e.g., a third enzyme, a fourth enzyme, a fifth enzyme, etc. The additional enzyme(s) can comprise any of the herbicide-detoxifying enzymes described herein.

A further method for detoxifying an auxin herbicide is provided. The method comprises contacting the auxin herbicide with an enzyme, wherein the enzyme comprises a monooxygenase, a phenolic acid decarboxylase, a chlorohydrolase, or a combination of any thereof. The method further comprises contacting the auxin herbicide with a pesticide, wherein the enzyme is not capable of degrading the pesticide.

A further method for degrading an auxin plant growth regulator is also provided. The method comprises contacting the auxin plant growth regulator with an enzyme, wherein the enzyme comprises a monooxygenase, a phenolic acid decarboxylase, a chlorohydrolase, or a combination of any thereof. The method further comprises contacting the auxin plant growth regulator with a pesticide, wherein the enzyme is not capable of degrading the pesticide.

A further method for degrading an auxin plant growth regulator or detoxifying an auxin herbicide is provided. The method comprises contacting the auxin herbicide or the auxin plant growth regulator with a 2,4-D-alpha ketoglutarate dioxygenase enzyme and a hydroxylase enzyme and/or a ring cleaving dioxygenase enzyme.

When the method comprises contacting the auxin herbicide or auxin plant growth regulator with a 2,4-D-alpha ketoglutarate dioxygenase enzyme, the 2,4-D-alpha ketoglutarate dioxygase enzyme can comprise an amino acid sequence having at least 70%, The 2,4-D-alpha ketoglutarate dioxygase enzyme can comprise an amino acid sequence having at least 75% identity to any one of SEQ ID NOs. 276-278

The 2,4-D-alpha ketoglutarate dioxygase enzyme can comprise an amino acid sequence having at least 80% identity to any one of SEQ ID NOs. 276-278

The 2,4-alpha ketoglutarate dioxygase enzyme can comprise an amino acid sequence having at least 85% identity to any one of SEQ ID NOs. 276-278

The 2,4-D-alpha ketoglutarate dioxygase enzyme can comprise an amino acid sequence having at least 90% identity to any one of SEQ ID NOs. 276-278

The 2,4-D-alpha ketoglutarate dioxygase enzyme can comprise an amino acid sequence having at least 95% identity to any one of SEQ ID NOs, 276-278

The 2,4-D-alpha ketoglutarate dioxygase enzyme can comprise an amino acid sequence having at least 98% identity to any one of SEQ ID NOs. 276-278

The 2,4-D)-alpha ketoglutarate dioxygase enzyme can comprise an amino acid sequence having at least 99% identity to any one of SEQ ID NOs. 276-278

The 2,4-D-alpha ketoglutarate dioxygase enzyme can comprise an amino acid sequence having or 100% identity to any one of SEQ ID NOs. 276-278

The 4-D-alpha ketoglutarate dioxygenase enzyme can comprise an amino acid sequence having at least 70% identity to SEQ ID NO: 276, wherein the alanine residue at position 198 of SEQ ID NO: 276 is replaced with a valine residue.

The 4-D-alpha ketoglutarate dioxygenase enzyme can comprise an amino acid sequence having at least 75% identity to SEQ ID NO: 276, wherein the alanine residue at position 198 of SEQ ID NO: 276 is replaced with a valine residue.

The 4-D-alpha ketoglutarate dioxygenase enzyme can comprise an amino acid sequence having at least 80% identity to SEQ ID NO: 276, wherein the alanine residue at position 198 of SEQ ID NO: 276 is replaced with a valine residue.

The 4-D-alpha ketoglutarate dioxygenase enzyme can comprise an amino acid sequence having at least 85% identity to SEQ ID NO: 276, wherein the alanine residue at position 198 of SEQ ID NO: 276 is replaced with a valine residue.

The 4-D-alpha ketoglutarate dioxygenase enzyme can comprise an amino acid sequence having at least 90% identity to SEQ ID NO: 276, wherein the alanine residue at position 198 of SEQ ID NO: 276 is replaced with a valine residue.

The 4-D-alpha ketoglutarate dioxygenase enzyme can comprise an amino acid sequence having at least 95% identity to SEQ ID NO: 276, wherein the alanine residue at position 198 of SEQ ID NO: 276 is replaced with a valine residue.

The 4-D-alpha ketoglutarate dioxygenase enzyme can comprise an amino acid sequence having at least 98% identity to SEQ ID NO: 276, wherein the alanine residue at position 198 of SEQ ID NO: 276 is replaced with a valine residue.

The 4-D-alpha ketoglutarate dioxygenase enzyme can comprise an amino acid sequence having or at least 99% identity to SEQ ID NO: 276, wherein the alanine residue at position 198 of SEQ ID NO: 276 is replaced with a valine residue.

The 2,4-D-alpha ketoglutarate dioxygenase enzyme can comprise SEQ ID NO: 277.

When the method comprises contacting the auxin herbicide or auxin plant growth regulator with a hydroxylase enzyme, the hydroxylase enzyme can comprise an amino acid sequence having at least 70%, The hydroxylase enzyme can comprise an amino acid sequence having at least 75% identity to SEQ ID NO: 281.

The hydroxylase enzyme can comprise an amino acid sequence having at least 80% identity to SEQ ID NO: 281.

The hydroxylase enzyme can comprise an amino acid sequence having at least 85% identity to SEQ ID NO: 281.

The hydroxylase enzyme can comprise an amino acid sequence having at least 90% identity to SEQ ID NO: 281.

The hydroxylase enzyme can comprise an amino acid sequence having at least 95% identity to SEQ ID NO: 281.

The hydroxylase enzyme can comprise an amino acid sequence having at least 98% identity to SEQ ID NO: 281.

The hydroxylase enzyme can comprise an amino acid sequence having at least 99% identity to SEQ ID NO: 281.

The hydroxylase enzyme can comprise an amino acid sequence having or 100% identity to SEQ ID NO: 281.

The hydroxylase enzyme can comprise SEQ ID NO: 281.

Alternatively, or in addition, the method can comprise contacting the auxin herbicide or the auxin plant growth regulator with a ring-cleaving dioxygenase enzyme.

The ring-cleaving dioxygenase enzyme can comprise an amino acid sequence having at least 95% identity to SEQ ID NO: 283.

The ring-cleaving dioxygenase enzyme can comprise an amino acid sequence having at least 98% identity to SEQ ID NO: 283.

The ring-cleaving dioxygenase enzyme can comprise an amino acid sequence having at least 99% identity to SEQ ID NO: 283.

The ring-cleaving dioxygenase enzyme can comprise an amino acid sequence having 100% identity to SEQ ID NO: 283.

The ring-cleaving dioxygenase can comprise SEQ ID NO: 283.

The ring-cleaving dioxygenase can be capable of detoxifying one or more herbicides selected from the group consisting of 2,4-dichlorophenoxyacetic acid (2,4-D), 4-(2,4-dichlorophenoxy)butyric acid (2,4-DB), 2-methyl-4-chlorophenoxyacetic acid (MCPA), mecoprop, dicamba, or a combination of any thereof.

In any of the methods that comprise contacting an auxin herbicide or an auxin plant growth regulator with an enzyme and a pesticide that the enzyme cannot degrade, the method can comprise concurrently contacting the auxin herbicide or the auxin plant growth regulator with the enzyme and the pesticide.

Alternatively, the method can comprise sequentially contacting the auxin herbicide or the auxin plant growth regulator with the enzyme and the pesticide.

In any of the methods that comprise contacting an auxin herbicide or an auxin plant growth regulator with an enzyme and a pesticide that the enzyme cannot degrade, the pesticide can comprise any of the pesticides described in Section VIII below.

In any of the methods for detoxifying an auxin herbicide or degrading an auxin plant growth regulator, the method can further comprise contacting the auxin herbicide or auxin plant growth regulator with a cofactor-regenerating enzyme. The cofactor-regenerating enzyme can comprise any of the cofactor regenerating enzymes described in Section IX below.

In any of the methods comprising contacting the auxin the auxin herbicide or auxin plant growth regulator with a cofactor-regenerating enzyme, the method can further comprise contacting the auxin herbicide or an auxin plant growth regulator with a substrate for the cofactor-regenerating enzyme. The substrate can comprise any of the substrates discussed in Section IX below.

In any of the methods for detoxifying an auxin herbicide or degrading an auxin plant growth regulator, the method can further comprise contacting the auxin herbicide or auxin plant growth regulator with a colorimetric detection agent.

The colorimetric detection agent can comprise any of the agents described in Section X below.

Where the method comprises the use of a colorimetric detection agent, the method can further comprise providing the colorimetric detection agent together with an additional enzyme that reacts with and causes a color change in the colorimetric detection agent. The additional enzymes that can be used for this purpose are described below in Section X.

In any of the methods described herein, contacting the auxin herbicide, the auxin plant growth regulator, the surface, the soil, the soilless media, the water, the sludge, the plant, the plant seed, the plant growth medium, or the area surrounding the plant or the plant seed with the enzyme, the first enzyme, or the second enzyme can comprise contacting the auxin herbicide, the auxin plant growth regulator, the surface, the soil, the soilless media, the water, the sludge, the plant, the plant seed, the plant growth medium, or the area surrounding the plant or the plant seed with a composition comprising a carrier and the enzyme, the first enzyme, or the second enzyme.

The carrier can comprise an agriculturally acceptable carrier.

The carrier can comprise a carrier not associated with the enzyme in nature.

The carrier can comprise a surfactant, a metal salt, a metal ion, or a combination of any thereof.

Metal salts and/or metal ions are particularly suitable as carriers for chlorohydrolases. For example, the enzyme, the first enzyme, or the second enzyme can comprise a chlorohydrolase and the carrier can comprise a metal salt, a metal ion, or a combination thereof.

The chlorohydrolase and the metal ion or metal salt can be present in synergistically effective amounts.

The metal ion can comprise $Fe^{3+}$, $Fe^{2+}$, $Zn^{2+}$, $Mn^{2+}$, $Cu^{2+}$, $Cu^+$ or $Mg^{2+}$, and/or the metal salt can comprise $MnSO_4$ The chlorohydrolase can comprise SEQ ID NO: 167 or 169 and wherein the metal salt comprises $MnSO_4$ or wherein the metal ion comprises $Mn^{2+}$ V. Methods for Decontaminating Surfaces of an Apparatus Used in Agriculture or Pesticide Manufacturing Any of the enzymes described herein can be used in methods for decontaminating surfaces of an apparatus used in agriculture or pesticide manufacturing. For example, when an herbicidal composition is sprayed, a residual amount of the active herbicide typically remains in the tank or agricultural vessel. This herbicide residue, if left untreated, can pose a significant problem for farmers by unintentionally damaging crops and other desirable plants located near the sprayed fields or growing on regions bordering a sprayed field. As a result, special precautions must be taken to prepare spray tanks and vessels for subsequent use following the application of pesticides. This problem is particularly acute for auxin herbicides, such as dicamba, where even small amounts of herbicidal residue can result in significant damage to sensitive crop plants.

Due to the high potency of dicamba and 2,4-D, three or more full rinses of a spray tank are typically required to ensure zero crop damage from the residue. Typical cleaning methods require the cleaning rinse to stand in the spray tank for a minimum of four to five hours, and preferably should be allowed to soak overnight. This process is expensive, time consuming, and cumbersome. The rinses require additional water in the field, and the long soaking period reduces the time that the equipment is available for spraying crops.

An alternative method of detoxifying/degrading pesticidal residue in a tank, vessel, and equipment or in a field, which reduces the water use and time required for the farmer to switch to another pesticide, is therefore highly desirable.

Accordingly, methods for decontaminating a surface of an apparatus used in agriculture or pesticide manufacturing are provided herein.

Any of the methods described above in Section IV can be used for decontaminating a surface of an apparatus used in agriculture or pesticide manufacturing, wherein the surface is contaminated with the auxin herbicide or the auxin plant growth regulator. Such methods comprise contacting the surface with the enzyme or enzymes.

A further method for decontaminating a surface is provided. The surface is a surface of an apparatus used in agriculture or pesticide manufacturing, wherein the surface is contaminated with an auxin herbicide or an auxin plant growth regulator. The method comprises contacting the surface with an enzyme. The enzyme comprises a free monooxygenase.

Another method for decontaminating a surface is provided. The surface is a surface of an apparatus used in agriculture or pesticide manufacturing, wherein the surface is contaminated with an auxin herbicide or an auxin plant growth regulator. The method comprises contacting the surface with an enzyme. The enzyme comprises a phenolic acid decarboxylase.

In any of the methods for decontaminating a surface of an apparatus used in agriculture or pesticide manufacturing, the surface can comprise a surface of an irrigation system or a component thereof (e.g., an irrigation line), a surface of a container (e.g., a tank, a jug, a basin, a drum, a carboy, a silo, a grain storage container, or a chamber), a surface of a sprayer (e.g., a boom sprayer), a surface of a mixer, a surface of a pump, a surface of an injection device, a surface of an applicator, a surface of a hopper, a surface of a wick wiper, a surface of a nozzle, a surface of a pipe, a surface of a valve, a surface of a hose, a surface of tubing, or a combination of any thereof.

Where the surface comprises a surface of a tank, the tank can comprise a storage tank, a bulk tank, a spray tank, a rinse tank, a dip tank, a wash tank, a mixing tank, or a combination of any thereof.

Surfaces that can be decontaminated using the enzymes include, but are not limited to surfaces of: farm field and farmstead machinery used for the production of crops and agricultural livestock, major product lines that include but are not limited to wheel and track-laying agricultural tractors, planting and fertilizing machinery, tillage equipment, fertilizer and chemical application equipment, tillage, sowing and planting equipment, harvesting machinery, having and mowing machinery, packing sheds and associated equipment, sprayers and spraying equipment including spray lines (boomspray, misters, airblasters, aircraft, helicopters, drones, unmanned aerial vehicles (UAVs), all-terrain vehicles (ATVs), knapsacks, etc.), irrigation equipment and systems, commercial turf and grounds care equipment, and parts for farm machinery.

For example, the surfaces of agricultural application and spray equipment that can be decontaminated using the enzymes, include, but are not limited to, the surfaces of: boom sprayers, wet booms and spraying equipment including spray lines, general misters, knapsack sprayers, handheld sprayers, squeeze packs, ready-to-use packs (RTU), mechanical sprayers, hydraulic sprayers (including a tank, a pump, a lance for single nozzles or boom, and a nozzle or multiple nozzles), spray nozzles, kegs, hoses, hose adaptors or connectors, lines and pipes, nozzle bodies, spray guns, pumps, desalinaters, suction probes, taps, valves, filters, in line filters, in-line measuring systems, microsmatic fittings and couplings, drum probes, recirculation rosettes, solenoids, direct injection lines, drop hoses, lances, fans, fertilizer works, and chemical application lines. Fertigation/fumigation equipment and systems include: fumigators, soil injection systems, and foggers. In furrow equipment and systems include: tillage and other application equipment including in furrow applicators and soil injection systems, pumps and hoses, granular fertilizer systems, super spreaders and other granular broadcast systems, granular induction systems (also referred to as "vac grans" or "granny pots"), impregnated granules, soil mats, and soil injectors. Grain associated equipment includes: grain dryers and blowers, grain movement, transport and storage equipment (including silos, ships, rail cars, trucks, storage pits, grain bunkers, augers, grain belts, grain elevators, grain beds, grain bunkers, silage pits, pre-mixing hopper, etc.). Irrigation equipment includes: irrigation pipes, siphons, channels, trickle systems, sprinklers and overhead sprinklers. Storage equipment includes: drums, vessels, tanks, boom sprayers, nurse tanks, and fertilizer tanks. The surfaces of other agricultural equipment that can be decontaminated using the enzymes include hydroponics, seed treatment equipment, and equipment related to the wine and food industry, including but not limited to, the surfaces of: hydroponic equipment and systems, fertigation and irrigation equipment, seed treatment equipment and systems, mixing and transfer drums and apparatuses, syringes, pipettes, wine making facilities, wine making equipment and systems includes apparatuses for manufacturing, transfer and storage, wine barrels, drums, vessels, storage containers and other types of apparatuses and vessels used in the food industry, enviro-drums, shuttles, and intermediate bulk containers (IBCs). Other facilities can include: wine making facilities, wine making equipment and systems includes apparatuses for manufacturing, transfer and storage, wine barrels, drums, vessels, storage containers and other types of apparatuses and vessels used in the food industry, enviro-drums, shuttles, and intermediate bulk containers (IBCs).

The enzymes can also be used to decontaminate surfaces of laboratory or production manufacturing environments (lines, nozzles, mixers, connectors, vessels and pumps etc.).

The enzymes can additionally be used to decontaminate surfaces of equipment used in animal husbandry, including, for example, equipment used in animal feeding (e.g., feeding stations), animal milking, animal harvesting, and animal housing.

In addition, the enzymes can be used to decontaminate surfaces of equipment used for treating fruits and vegetables to remove herbicide residues, including, but not limited to surfaces of: dipping or washing equipment, washing systems, pre- and post-harvest treatment areas, dipping or washing baths, fruit batch showers, fruit dipping baths, post-harvest dipping stations, packing facilities, transport and storage facilities, distribution centers, supermarkets and storage facilities (warehouses sheds/houses).

In any of the methods for decontaminating a surface, contacting the surface with the enzyme or enzymes can comprise dissolving an tablet or a powder comprising an effervescent agent and the enzyme or enzymes in water in contact with the surface.

The effervescent agent can comprise a bicarbonate, a carbonate, a tartarate, or a combination of any thereof.

In any of the methods for decontaminating a surface, the method can further comprise contacting the surface with a cofactor-regenerating enzyme. The cofactor-regenerating enzyme can comprise any of the cofactor regenerating enzymes described in Section IX below.

In any of the methods comprising contacting the surface with a cofactor-regenerating enzyme, the method can further comprise contacting the surface with a substrate for the cofactor-regenerating enzyme. The substrate can comprise any of the substrates discussed in Section IX below.

In any of the methods for decontaminating a surface, the method can further comprise contacting the surface with a colorimetric detection agent. The colorimetric detection agent can comprise any of the agents described in Section X below.

Where the method comprises the use of a colorimetric detection agent, the method can further comprise providing the colorimetric detection agent together with an additional enzyme that reacts with and causes a color change in the colorimetric detection agent. The additional enzymes that can be used for this purpose are described below in Section X.

In any of the methods comprising decontaminating a surface, the method can further comprise reducing the concentration of the auxin herbicide or the auxin plant growth regulator on the surface, or in a rinsate from the surface, to a safe zone. As used herein, the term "safe zone" refers to a concentration that will not cause injury to a plant or harm to the environment. Therefore, in any of the methods comprising decontaminating a surface, the method can result in a reduction of the concentration of the auxin herbicide or the auxin plant growth regulator in rinsate from the apparatus to a concentration that will not cause injury to a plant or harm to the environment.

In any of the methods comprising decontaminating a surface, the auxin herbicide can comprise dicamba. The concentration of dicamba can be reduced to a level of 15 mg/L or lower.

VI. Methods for Decontaminating Water, Soil, Soilless Media, or Sludge

Any of the enzymes described herein can be used for decontamination of water, soil, soilless media, or sludge.

Any of the methods described above in Section IV can be used for decontaminating water, soil, soilless media, or sludge, wherein the water, soil, soilless media, or sludge is contaminated with the auxin herbicide or the auxin plant growth regulator. Such methods comprise contacting the water, soil, soilless media, or sludge with the enzyme or enzymes.

A further method for decontaminating soil, soilless media, water, or sludge is provided. The soil, soilless media, water, or sludge is contaminated with an auxin herbicide or an auxin plant growth regulator. The method comprises contacting the soil, soilless media, water, or sludge, with an enzyme, the enzyme comprising a free monooxygenase or a free phenolic acid decarboxylase.

Another method for decontaminating soil, soilless media, water, or sludge is provided. The soil, soilless media, water, or sludge is contaminated with an auxin herbicide or an auxin plant growth regulator. The method comprises contacting the water, soilless media, or sludge with an enzyme. The enzyme comprises a phenolic acid decarboxylase.

Typical areas that may contain water, soil, soilless media, or sludge that can be decontaminated using the methods described herein include, but are not limited to: greenhouses, nurseries, nursery pots, planting transplant stations, seed grading and treatment sheds/houses, cold storage and packaging houses, post-harvest treatment areas, transport and storage facilities, distribution stations, drum return stations, feeding stations, granular fertilizer plants, supermarkets, and households.

Further areas that may contain water, soil, soilless media, or sludge that can be decontaminated using the methods described herein include, but are not limited to: fields (to reduce or protect from spray drift and/or volatility), areas adjacent to fields, areas that border fields, hydroponic growing areas, rangeland, pastures, roadsides, forests, plantations, nurseries, gardens, parks, turf, golf courses, sport fields, industrial lands right of ways, public amenities areas, glasshouses and shadehouses.

Any of the methods for decontaminating water, soil, soilless media, or sludge described herein can be used for decontamination of a pasture, the border of a field (to reduce or protect from spray drift and/or volatility), buffer zones or set back areas, gardens, natural vegetation and environments, a bio-bed or a biofilter used to deal with drips, spills, and splashes that occur in sprayer handling areas, or fertigation or irrigation areas.

The method can comprise decontaminating water.

For example, the contaminated water can comprise water in a reservoir, an aquifer, a lake, a river, a stream, a pond (e.g., a retention pond), a pool, a lagoon, a dam, a trough, an irrigation system, or a rice paddy; water from run-off irrigation; waste water (e.g., grey water); drinking water; water in an aquaculture system; water in a hydroponics system, water in a water transfer system; or a combination of any thereof.

Where the water comprises waste water, the water can be pretreated with the enzyme or enzymes while in or prior to entering the waste water stream.

In addition, for decontamination of water, the enzymes can be contacted with, for example, hydroponic solutions and reservoirs, water storage areas including water tanks, bio-beds, ocean beds, lakes, ponds, dams, irrigation channels, waterways, or any other water bodies.

For example, the enzymes can be used for decontamination of water tanks, water storage vessels (for example, chemical back siphons), ponds, lakes, irrigation ditches or reservoirs, water from hydroponic farming, rinse water or waste water from agricultural spray application or equipment clean down, water catchment or run off areas, irrigation water, and channels.

Where the contaminated water comprises water in an aquaculture system, the methods for decontaminating water can be used: for cleaning fish tanks or aquariums; in fish (including caviar) and shrimp farming; in mollusk (e.g., oyster, mussel, clam, snails, squid, octopus) and echinoderm (e.g., sea urchin, *Echinoidea*) beds; and/or for maintenance or treatment of fresh water, salt water, and marine estuaries and in protecting fish, mollusks, marron and other crustaceans from agricultural chemicals spills, or spray drift. Where the enzymes are used in aquaculture, the enzymes can be applied in combination with additional agents such as algicides or molluscicides.

Where the method comprises decontaminating water, the method can comprise dissolving an effervescent tablet or powder comprising an effervescent agent and the enzyme or enzymes in the water.

The effervescent agent can comprise a bicarbonate, a carbonate, a tartarate, or a combination of any thereof.

The method can comprise decontaminating soil.

For example, the method can comprise decontaminating soil in an area where plants are to be planted.

The soil can comprise soil in a field, soil in a field border, soil in turf, soil in a pot, soil in a nursery, soil in a seed tray, mud, soil in an industrial area, soil in a rangeland, soil in a pasture, soil in a plantation, or a combination of any thereof.

For example, the soil can be soil near railroad tracks or a right-of-way.

In addition, for decontamination of soil, the enzymes can be contacted with, for example, to soil that has been treated with an auxin herbicide (e.g., dicamba), to soil located in or near areas where pesticides have been applied or where spray drift or volatility from pesticides may occur, or to soil in an area where water run-off containing auxin herbicide residue may occur and could result in a contamination problem to the soil.

For decontamination of soil, the enzyme can be added to the soil prior to or after a pesticide application, or to soil without any pesticide application where the soil contains or will be planted with pesticide sensitive plants as a reassurance of protection from injury or contamination.

The method can comprise decontaminating soilless media.

The soilless media can comprise sand, potting mix, vermiculite, perlite, dolomite, peat, mulch, or a combination of any thereof. For example, the method can comprise decontamination of sand on a beach.

The method can comprise decontaminating sludge.

In any of the methods for decontaminating soil, soilless media, water, or sludge, the method can further comprise contacting the water, soil, soilless media, or sludge with a cofactor-regenerating enzyme. The cofactor-regenerating enzyme can comprise any of the cofactor regenerating enzymes described in Section IX below.

In any of the methods comprising contacting the soil, soilless media, water, or sludge, with a cofactor-regenerating enzyme, the method can further comprise contacting the soil, soilless media, water, or sludge, with a substrate for the cofactor-regenerating enzyme. The substrate can comprise any of the substrates discussed in Section IX below.

In any of the methods for decontaminating soil, soilless media, water, or sludge, the method can further comprise contacting the water, soil, soilless media, or sludge with a colorimetric detection agent. The colorimetric detection agent can comprise any of the agents described in Section X below.

Where the method comprises the use of a colorimetric detection agent, the method can further comprise providing the colorimetric detection agent together with an additional enzyme that reacts with and causes a color change in the colorimetric detection agent. The additional enzymes that can be used for this purpose are described below in Section X.

VII. Methods for Protecting Plants from Auxin Herbicides, for Improving a Plants Tolerance for an Auxin Herbicide, and for Removing an Auxin Herbicide from the Surface of a Plant The enzymes can be used in methods for protecting plants from auxin herbicides, for improving the tolerance of a plant for an auxin herbicide, and for removing auxin herbicides from the surface of a plant.

Any of the methods described above in Section IV can be used for protecting a plant from an auxin herbicide, for improving a plant's tolerance for the auxin herbicide, or for removing the auxin herbicide from a surface of a plant. Such methods comprise applying the enzyme or enzymes to a plant, a plant seed, plant growth medium, or an area surrounding a plant or a plant seed.

A further method for protecting a plant from an auxin herbicide, for improving a plant's tolerance for an auxin herbicide, or for removing an auxin herbicide from a surface of a plant is provided. The method comprises applying any of the enzymes described in Sections I.E through I.H above to a plant, a plant seed, plant growth medium, or an area surrounding a plant or a plant seed. Alternatively or in addition, the method comprises applying any of the compositions described in Section II above to a plant, a plant seed, plant growth medium, or an area surrounding a plant or a plant seed.

Another method for protecting a plant from an auxin herbicide, for improving a plant's tolerance for an auxin herbicide, or for removing an auxin herbicide from a surface of a plant is provided. The method comprises applying an enzyme to a plant, a plant seed, plant growth medium, or an area surrounding a plant or a plant seed and wherein the enzyme comprises a monooxygenase, a phenolic acid decarboxylase, a chlorohydrolase, or a combination of any thereof.

In any of these methods, the method can comprise a method for protecting a plant from the auxin herbicide. For example, the enzyme, enzymes, or composition can be applied to the to a plant, a plant seed, plant growth medium, or an area surrounding a plant or a plant seed in order to protect the plant from herbicides that target weeds.

The detoxifying enzymes can be applied to a plant as a means to reduce the buffer zone for applying an auxin herbicide to a plant or field of plants. A "buffer zone" refers to the area or zone requirements specific for the custom applications of certain pesticides or herbicides necessary to avoid injury to non-target crop or other crop species. For example, buffer zone requirements or restrictions are developed for commercially available herbicides in conjunction with regulatory bodies that assess products for safety prior to product approval.

Alternatively or in addition, the method can comprise a method for improving a plant's tolerance for the auxin herbicide.

Improving a plant's tolerance for the auxin herbicide can in turn lead to other beneficial effects for the plant, including improved plant health, increased growth, and/or increased vigor. Improved plant health includes any positive effect on a plant, including, but not limited to increased growth, increased growth rate, increased plant height, increased plant weight, increased size or number of any plant part (e.g., leafs, roots, stems, seeds, tillers, flowers, flower buds, fruits, bracts, etc.), improved quality of seeds, increased germination, increased rate of germination, synchronous germination, increased nutrient uptake or content, increased crop yield, increased plant protection, decreased susceptibility to a pathogen, and decreased susceptibility to pests or environmental stresses.

The detoxifying enzymes can be used to protect crops and non-crop plants from injury due to unintentional contact with an auxin herbicide such as dicamba or 2,4-D.

The detoxifying enzymes can be applied as a preemergent, postemergent, preplant incorporation, or post-sowing but preemergent application. "Preemergent" applications are applied to an area of interest (for example, a field or area of cultivation) before a plant emerges visibly from the soil. "Postemergent" applications are applied to an area after a plant emerges visibly from the soil. "Preplant incorporation" typically involves the incorporation of compounds into the soil prior to planting or as a coating to a seed for use as a seed treatment.

The enzymes can also be applied to soil or any area where a plant or seed is to be planted, in order to protect the plant from injury from an auxin herbicide.

The enzyme, the enzymes, or the composition can be applied to the plant.

In any of the methods wherein an enzyme is applied to a plant, the enzyme can be applied to any part of the plant, including, but not limited to a leaf, a stem, a flower, a floral organ, a fruit, pollen, a vegetable, a tuber, a bulb, a root ball, a root stock, a root, or a seed.

For example, the method can comprise applying the enzyme, the enzymes, or the composition foliarly.

The method can comprise applying the enzyme, the enzymes, or the composition to roots of the plant. Application to plant roots can comprise application via a root drip or a drip irrigation line (e.g., for application to roots of trees).

The method can comprise applying the enzyme, the enzymes, or the composition to flowers or fruits of the plant.

The method can comprise applying the enzyme, the enzymes, or the composition to the plant seed. Where the enzymes are applied to a plant seed, the tolerance of a plant grown from the seed to an auxin herbicide can be enhanced.

The method can comprise applying the enzyme, the enzymes, or the composition to the plant growth medium.

The method can comprise applying the enzyme to the area surrounding a plant. For example, the method can comprise applying the enzyme, the enzymes, or the composition to a field border.

The method can comprise applying the enzyme, the enzymes, or the composition in a greenhouse.

In any of the method for protecting plants from auxin herbicides, for improving the tolerance of a plant for an auxin herbicide, and for removing auxin herbicides from the surface of a plant, applying the enzyme, the enzymes, or the composition to the plant protects the plant from herbicide drift.

"Drift" is the physical movement of spray particles of herbicide by wind after the particles leave the sprayer and before they reach their intended target. Drift mainly occurs when spray applications occur in unfavorable weather conditions, and most commonly happens when windy conditions occur during spray application. Spray application involving the use of a spray nozzle with a high percentage of droplets (e.g., a spray nozzle having a diameter of approximately 200 microns, typically about 100-150 microns) can increase drift.

Application of the enzymes to a plant, a plant seed, plant growth medium, or an area surrounding a plant or a plant seed can protect the plant from volatile auxin herbicides such as dicamba. "Volatility" refers to the movement of the gaseous form of the herbicide after it has been deposited on its intended target as a liquid. After deposition, the herbicide changes from a liquid to gaseous form, and the gaseous form moves off the target with wind currents and inversion layers. An herbicide's volatility is influenced by many factors, including its vapor pressure, concentration, and rate of transport to the surface of the leaf or soil. Other atmospheric conditions that influence volatility include the temperature of the air, leaf, or soil; the water content of leaf or soil surface; and the velocity of air movement above the surface of the leaf or soil.

The detoxifying enzymes described herein can be used to achieve high levels of protection of plants from unintentional contact with the herbicide due to evaporation, volatilization, drift or dissemination-related contact. The danger for drift is an ever-present concern for any herbicide application and a major concern for all crops, as well as non-crop plants. Dicamba containing herbicide formulations (e.g., generally salts or dimethylene formulations) can be particularly problematic related to these types of exposures.

Dicamba, for example, causes significant damage to plants even at extremely low application levels. Most dicotyledonous plants are sensitive to treatment with dicamba. For example, sensitive plants can show herbicide damage with symptoms pronounced after spraying dicamba even at the low level of 0.017 kg/ha with severity of symptoms increasing at 0.28 kg/ha and 0.56 kg/ha application levels normally used for weed control in agriculture. Sensitive dicot plants like tobacco display distinct injury symptoms even at levels of dicamba treatment as low as 0.001 to 0.01 kg/ha (Behrens et al., *Dicamba Resistance: Enlarging and Preserving Biotechnology-Based WeedManagement Strategies*, SCIENCE 316:1185-1188 (2007)).

The method can comprise a method for removing the auxin herbicide from the surface of the plant.

In any of the methods for removing the auxin herbicide from a surface of a plant, the method can comprise applying the enzyme, the enzymes, or the composition to an edible part of the plant, and wherein application of the enzyme, the enzyme, or the composition reduces the amount of the auxin herbicide on the edible part of the plant as compared to edible portions of the same type of plant to which the enzyme has not been applied.

The edible portion of the plant can comprise a fruit, a seed, a leaf, a root, a stalk, a flower, a tuber, a rhizome, a stamen, a resin, or a combination of any thereof.

The method can comprise dipping the edible part of the plant into a liquid containing the enzyme or enzymes.

For example, the method can comprise applying the enzyme, the enzyme, or the composition to fruits or vegetables to remove herbicide residues prior to or following harvest. Such treatments are commonly applied to fruits such as citrus, apples, apricots, plums, pears, peaches and vegetables. Pre- and post-harvest treatments are generally applied in the forms of dips or washes.

In any of the methods for protecting a plant from an auxin herbicide, for improving a plant's tolerance for an auxin herbicide, or for removing an auxin herbicide from a surface of a plant, the enzyme, enzymes, or composition detoxifies the auxin herbicide. The detoxification of the auxin herbicide is increased as compared to detoxification of the auxin herbicide in the absence of the enzyme, enzymes, or composition.

In any of the methods for protecting a plant from an auxin herbicide, for improving a plant's tolerance for an auxin herbicide, or for removing an auxin herbicide from a surface of a plant, the method can further comprise applying a cofactor-regenerating enzyme to the plant, plant seed, plant growth medium, or area surrounding the plant. The cofactor-regenerating enzyme can comprise any of the cofactor regenerating enzymes described in Section IX below.

In any of the methods comprising applying a cofactor-regenerating enzyme to the plant, plant seed, plant growth medium, or area surrounding the plant, the method can further comprise applying a substrate for the cofactor-regenerating enzyme to the plant, plant seed, plant growth medium, or area surrounding the plant. The substrate can comprise any of the substrates discussed in Section IX below.

In any of the methods for protecting a plant from an auxin herbicide, for improving a plant's tolerance for an auxin herbicide, or for removing an auxin herbicide from a surface of a plant, the method can further comprise applying a colorimetric detection agent to the plant, plant seed, plant growth medium, or area surrounding the plant. The colorimetric detection agent can comprise any of the agents described in Section X below.

Where the method comprises the use of a colorimetric detection agent, the method can further comprise providing the colorimetric detection agent together with an additional enzyme that reacts with and causes a color change in the colorimetric detection agent. The additional enzymes that can be used for this purpose are described below in Section X.

VIII. Pesticides not Degraded by the Detoxifying Enzymes

As discussed above in Section II.B, compositions are provided that comprise any of the herbicide-detoxifying enzymes described herein together with a pesticide that the enzyme cannot degrade.

In addition, as described above in Section IV, methods for detoxifying an auxin herbicide or degrading an auxin plant growth regulator are provided, wherein the methods comprise contacting the auxin herbicide auxin plant growth regulator an enzyme and with a pesticide, wherein the enzyme is not capable of degrading the pesticide.

The pesticide can comprise an herbicide, an insecticide, a fungicide, a hormone, a viricide, a bactericide, a nematicide or a combination of any thereof.

Where the pesticide comprises an herbicide, the herbicide can comprise a lipid synthesis inhibitor (e.g., a non-acetyl CoA carboxylase (ACCase) inhibitor, a long-chain fatty acid synthesis inhibitor, an acetyl-coA carboxylase (ACCase) inhibitor, or a combination of any thereof), an acetolactate synthase (ALS) inhibitor (e.g., a sulfonylurea), an 5-enolyl pyruvyl-shikimate-3-phosphate (EPSP) synthetase inhibitor, a phenoxy acid, a benzoic acid, a carboxylic acid, an auxin transport inhibitor, a photosystem II inhibitor, a glutamine synthetase inhibitor, a diterpene synthesis inhibitors, a 4-hydroxyphenylpyruvate dioxygenase (HPPD) inhibitor, a protoporphyrinogen oxidase (PPO) inhibitor, a photosystem I electron diverter, a microtubule inhibitor, a phytoene desaturase (PDS) inhibitor, a chloroacetamide, a carbamate, an arylpicolinate, or a combination of any thereof.

The herbicide suitably comprises a lipid synthesis inhibitor (e.g., a non-acetyl CoA carboxylase (ACCase) inhibitor, a long-chain fatty acid synthesis inhibitor, an acetyl-coA carboxylase (ACCase) inhibitor, or a combination of any thereof), an acetolactate synthase (ALS) inhibitor (e.g., a sulfonylurea), an 5-enolyl pyruvyl-shikimate-3-phosphate (EPSP) synthetase inhibitor, a photosystem II inhibitor, a glutamine synthetase inhibitor, a diterpene synthesis inhibitors, a 4-hydroxyphenylpyruvate dioxygenase (HPPD) inhibitor, a protoporphyrinogen oxidase (PPO) inhibitor, a photosystem I electron diverter, a microtubule inhibitor, a phytoene desaturase (PDS) inhibitor, a chloroacetamide, a carbamate, an arylpicolinate, or a combination of any thereof.

For example, where the pesticide comprises an herbicide, the herbicide can comprise acetochlor, acifluorfen, aclonifen, acrolein (2-propenal), alachlor, alloxydim, ametryn, amicarbazone, amidosulfuron, aminopyralid, aminocyclopyrachlor, amitrole, ammonium sulfamate, anilofos, arylpicolinate, asulam, atrazine, azimsulfuron, beflubutamid, benazolin, bencarbazone, benfluralin, benfuresate, bensulfuron-methyl, bensulide, bentazone, benzobicyclon, benzoienap, bifenox, bilanafos, bispyribac, bromacil, bromobutide, bromofenoxim, bromoxynil, butachlor, butafenacil, butamifos, butralin, butroxydim, butylate, cafenstrole, carbetamide, carfentrazone, catechin, chlomethoxyfen, chloramben, chlorburmon, chlorflurenol-methyl, chloridazon, chlorimuron-ethyl, chlorotoluron, chlorpropham, chlorsulfuron, chlorthal-dimethyl, chlorthiamid, chlortoluron, cinidon-ethyl, cinmethylin, cinosulfuron, clethodim, clodinafop-propargyl, clomazone, clopyralid, cloransulam-methyl, CUH-35 (2-methoxy ethyl 2-[[[4-chloro-2-fluoro-5-[(1-methyl-2-propynyl)oxy]phenyl](3-fluorobenzoyl)amino]carbonyl]-1-cyclohexene-1-carboxylate), cumyluron, cyanazine, cycloate, cyclosulfamuron, cycloxydim, cyhalofop-butyl, daimuron, dalapon, dazomet, desmedipham, desmetryn, dichlobenil, diclofop, diclosulam, difenzoquat metilsulfate, diflufenican, diflufenzopyr, dimefuron, dimepiperate, dimetmethachlor, dimethametryn, dimethenamid, dimethipin, dimethylarsinic acid, dinitramine, dinoterb, diphenamid, diquat, dithiopyr, diuron, dinitro-ortho-cresol (DNOC), endothal, S-ethyl dipropylthiocarbamate (EPTC), esprocarb, ethalfluralin, ethametsulfuron-methyl, ethofumesate, ethoxyfen, ethoxysulfuron, etobenzanid, fentrazamide, fenuron, flazasulfuron, flopyrauxifen, florasulam, fluazifop, flucarbazone, flucetosulfuron, fluchloralin, flufenacet, flufenpyr, flumetsulam, flumiclorac-pentyl, flumioxazin, fluometuron, fluoroglycofen-ethyl, flupyrsulfuron-methyl, flurenol, fluridone, flurochloridone, fluroxypyr, flurtamone, fluthiacet-methyl, fomesafen, foramsulfuron, fosamine-ammonium, guizalop, glufosinate, glyphosate, halauxifen-methyl, halosulfuronmethyl, haloxyfop-etotyl, haloxyfop-methyl, hexazinone, HOK-201 (N-(2,4-difluorophenyl)-1,5-dihydro-N-(1-methylethyl)-5-oxo-1-[(tetrahydro-2-pyranylmethyl-4H-1, 2,4-triazole-4-carboxamide), imazamethabenz, imazamox, imazapic, imazapyr, imazaquin, imazethapyr, imazosulfuron, indanofan, iodosulfuron, ioxynil, isoproturon, isouron, isoxaben, isoxaflutole, lactofen, lenacil, linuron, maleic hydrazide, mefenacet, mefluidide, mesosulfuron, mesotrione, metam-sodium, metamifop, metamitron, metazachlor, methabenzthiazuron, methylarsonic acid, methyldymron, metobenzuron, metobromuron, metolachlor, metosulam, metoxuron, metribuzin, metsulfuron-methyl, molinate, monolinuron, naproanilide, napropamide, naptalam, neburon, nicosulfuron, norflurazon, orbencarb, oryzalin, oxadiargyl, oxadiazon, oxasulfuron, oxaziclomefone, oxyfluorfen, paraquat, pebulate, pelargonic acid, pendimethalin, penoxsulam, pentanochlor, pentoxazone, perfluidone, pethoxyamid, phenmedipham, picloram, picolinafen, pinoxaden, piperofos, pretilachlor, primisulfuron-methyl, prodiamine, profoxydim, prometon, prometryn, propachlor, propanil, propaquizafop, propazine, propham, propisochlor, propoxycarbazone, propyzamide, prosulfocarb, prosulfuron, pyracionil, pyraflufen-ethyl, pyroxasulfone, pyrasulfotole, pyrazogyl, pyrazolynate, pyrazoxyfen, pyrazosulfuronethyl, pyribenzoxim, pyributicarb, pyridate, pyridine, pyriftalid, pyriminobac-methyl, pyrimisulfan, pyrithiobac, pyroxsulam, quinclorac, quinmerac, quinoclamine, quinolinone, quizalofop-ethyl, quizalofop-P-tefuryl, rimsulfuron, safluenacil, sethoxydim, siduron, simazine, simetryn, sulcotrione, sulfentrazone, sulfometuron-methyl, sulfosulfuron, trichloroacetate (TCA), tebutam, tebuthiuron, tefuryltrione, tembotrione, tepraloxydim, terbacil, terbumeton, terbuthylazine, terbutryn, thenylchlor, thiazopyr, thiencarbazone, thiobencarb, tiocarbazil, topramezone, tralkoxydim, triallate, tribenuron, thifensulfuron, triasulfuron, triaziflam, triclopyr, tridiphane, trietazine, trifloxysulfuron, trifluralin, triflusulfuron-methyl, tritosulfiiron, vernolate, or a combination of any thereof.

The herbicide preferably comprises acetochlor, acifluorfen, aclonifen, acrolein (2-propenal), alachlor, alloxydim, ametryn, amicarbazone, amidosulfuron, aminocyclopyrachlor, amitrole, ammonium sulfamate, anilofos, arylpicolinate, asulam, atrazine, azimsulfuron, beflubutamid, benazolin, bencarbazone, benfluralin, benfuresate, bensulfuron-methyl, bensulide, bentazone, benzobicyclon, benzoienap, bifenox, bilanafos, bispyribac, bromacil, bromobutide, bromofenoxim, bromoxynil, butachlor, butafenacil, butamifos, butralin, butroxydim, butylate, cafenstrole, carbetamide, carfentrazone, catechin, chlomethoxyfen, chlorbromuron, chlorflurenol-methyl, chloridazon, chlorimuron-ethyl, chlorotoluron, chlorpropham, chlorsulfuron, chlorthal-dimethyl, chlorthiamid, chlortoluron, cinidon-ethyl, cinmethylin, cinosulfuron, clethodim, clodinafop-propargyl, clomazone, cloransulam-methyl, CUH-35 (2-methoxy ethyl 2-[[[4-chloro-2-fluoro-5-[(1-methyl-2-propynyl)oxy]phenyl](3-fluorobenzoyl)amino]carbonyl]-1-cyclohexene-1-carboxylate), cumyluron, cyanazine, cycloate, cyclosulfamuron, cycloxydim, cyhalofop-butyl, daimuron, dalapon, dazomet, desmedipham, desmetryn, dichlobenil, diclofop, diclosulam, difenzoquat metilsulfate, diflufenican, dimefuron, dimepiperate, dimethachlor, dimethametryn, dimethenamid, dimethipin, dimethylarsinic acid, dinitramine, dinoterb, diphenamid, diquat, diuron, dinitro-ortho-cresol (DNOC), endothal, S-ethyl dipropylthiocarbamate (EPTC), esprocarb, ethalfluralin, ethametsulfuron-methyl, ethofumesate, ethoxyfen, ethoxysulfuron, etobenzanid, fentrazamide, fenuron, flazasulfuron, flopyrauxifen, florasulam, fluazifop, flucarbazone, flucetosulfuron, fluchloralin, flufenacet, flumetsulam, flumiclorac-pentyl, flumioxazin, fluometuron, fluoroglycofen-ethyl, flupyrsulfuron-methyl, flurenol, fluridone, flurochloridone, flurtamone, fluthiacet-methyl, fomesafen, foramsulfuron, fosamine-ammonium, guizalop, glufosinate, glyphosate, halauxifen-methyl, halosulfuron-methyl, haloxyfop-etotyl, haloxyfop-methyl, hexazinone, HOK-201 (N-(2,4-difluorophenyl)-1,5-dihydro-N-(1-methylethyl)-5-oxo-1-[(tetrahydro-2-pyranylmethyl-4H-1,2,4-triazole-4-carboxamide), imazamethabenz, imazarmox, imazapic, imazaquin, imazosulfuron, indanofan, iodosulfuron, ioxynil, isoproturon, isouron, isoxaben, isoxaflutole, lactofen, lenacil, linuron, maleic hydrazide, mefenacet, mefluidide, mesosulfuron, mesotrione, metam-sodium, metamifop, metamitron, metazachlor, methabenzthiazuron, methylarsonic acid, methyldymron, metobenzuron, metobromuron, metolachlor, metosulam, metoxuron, metribuzin, metsulfuron-methyl, molinate, monolinuron, naproanilide, napropamide, naptalam, neburon, nicosulfuron, norflurazon, orbencarb, oryzalin, oxadiargyl, oxadiazon, oxasulfuron, oxaziclomefone, oxyfluorfen, paraquat, pebulate, pelargonic acid, pendimethalin, penoxsulam, pentanochlor, pentoxazone, perfluidone, pethoxyamid, phenmedipham, picolinafen, pinoxaden, piperofos, pretilachlor, primisulfuron-methyl, prodiamine, profoxydim, prometon, prometryn, propachlor, propanil, propaquizafop, propazine, propham, propisochlor, propoxycarbazone, propyzamide, prosulfocarb, prosulfuron, pyraclonil, pyraflufen-ethyl, pyroxasulfone, pyrasulfotole, pyrazogyl, pyrazolynate, pyrazoxyfen, pyrazosulfuron-ethyl, pyribenzoxim, pyributicarb, pyridate, pyriftalid, pyriminobac-methyl, pyrimisulfan, pyroxsulam, quinoclamine, quizalofop-ethyl, quizalofop-P-tefuryl, rimsulfuron, safluenacil, sethoxydim, siduron, simazine, simetryn, sulcotrione, sulfentrazone, sulfometuron-methyl, sulfosulfuron, trichloroacetate (TCA), tebutam, tebuthiuron, tefuryltrione, tembotrione, tepraloxydim, terbacil, terbumeton, terbuthylazine, terbutryn, thenylchlor, thiencarbazone, thiobencarb, tiocarbazil, topramezone, tralkoxydim, triallate, tribenuron, thifensulfuron, triasulfuron, triaziflam, tridiphane, trietazine, trifloxysulfuron, trifluralin, triflusulfuron-methyl, tritosulfuron, vernolate, or a combination of any thereof.

The herbicide more preferably comprises acetochlor, atrazine, bromoxynil, butroxydim, carfentrazone, chlorimuron-ethyl, chlorsulfuron, chlortoluron, clethodim, diclofop, diflufenican, dimethenamid, diquat, diuron, florasulam, fluazifop, flufenacet, flumetsulam, flumioxazin, fluometuron, fomesafen, glufosinate, glyphosate, halosulfuron-methyl, imazamethabenz, imazethapyr, iodosulfuron, isoxaflutole, mesosulfuron, mesotrione, metazachlor, metolachlor, metribuzin, metsulfuron-methyl, nicosulfuron, oryzalin, paraquat, pendimethalin, picolinafen, prometryn, propyzamide, prosulfocarb, pyroxasulfone, pyrasulfotole, pyridate, rimsulfuron, sethoxydim, simazine, sulcotrione, sulfentrazone, sulfometuron-methyl, tembotrione, topramezone, tralkoxydim, triallate, tribenuron, thifensulfuron, triasulfuron, trifluralin, or a combination of any thereof.

Where the herbicide comprises acifluorfen, the acifluorfen can comprise acifluorfen sodium.

Where the herbicide comprises benazolin, the benazolin can comprise benazolin-ethyl.

Where the herbicide comprises bispyribac, the bispyribac can comprise bispyribac sodium.

Where the herbicide comprises bromoxynil, the bromoxynil can comprise bromoxynil octanoate, bromoxynil heptoanoate, or a combination thereof.

Where the herbicide comprises carfentrazone, carfentrazone can comprise carfentrazone-ethyl.

Where the herbicide comprises clopyralid, the clopyralid can comprise clopyralid-olamine, clopyralid potassium, clopyralid dimethylamine, clopyralid trisopropanolamine (TIPA), or a combination of any thereof.

Where the herbicide comprises dapalon, the dapalon can comprise dalapon-sodium.

Where the herbicide comprises diclofop, the diclofop can comprise diclofop-methyl.

Where the herbicide comprises dimethenamid, the dimethenamid can comprise dimethenamid-P.

Where the herbicide comprises dimethylarsinic acid, the dimethylarsinic acid can comprise a sodium salt of dimethylarsinic acid.

Where the herbicide comprises diquat, the diquat can comprise diquat dibromide.

Where the herbicide comprises fenuron, the fenuron comprises fenuron-trichloroacetate (fenuron-TCA).

Where the herbicide comprises fluazifop, the fluazifop can comprise fluazifop-P, fluazifop-butyl, fluazifop-P-butyl, or a combination of any thereof.

Where the herbicide comprises flufenpyr, the flufenpyr can comprise flufenpyr-ethyl.

Where the herbicide comprises flupyrsulfuron-methyl, the flupyrsulfuron-methyl can comprise flupyrsulfuron-methyl-sodium.

Where the herbicide comprises flurenol, the flurenol can comprise flurenol-butyl.

Where the herbicide comprises glufosinate, the glufosinate can comprise glufosinate-ammonium.

Where the herbicide comprises glyphosate, the glyphosate can comprise a glyphosate salt.

For example, the glyphosate salt can comprise glyphosate ammonium, glyphosate isopropylammonium, glyphosate potassium, a sodium salt of glyphosate (e.g., glyphosate sesquisodium), glyphosate trimesium (sulfosate), a dimethylamine salt of glyphosate, a monomethylamine salt of glyphosate, a metal salt of glyphosate (e.g., a lithium salt of glyphosate), or a combination thereof.

Where the herbicide comprises imazamethabenz, the imazamethabenz can comprise imazamethabenz-methyl.

Where the herbicide comprises imazaquin, the imazaquin can comprise imazaquin-ammonium.

Where the herbicide comprises imazethapyr, the imazethapyr can comprise imazethapyr-ammonium.

Where the herbicide comprises iodosulfuron, the iodosulfuron can comprise iodosulfuron-methyl.

Where the herbicide comprises ioxynil, the ioxynil can comprise ioxynil octanoate, ioxynil-sodium, or a combination thereof.

Where the herbicide comprises mesosulfuron, the mesosulfuron can comprise mesosulfuron-methyl.

Where the herbicide comprises methylarsonic acid, the methylarsonic acid can comprise methylarsonic acid calcium, methylarsonic acid monoammonium, methylarsonic acid monosodium, methylarsonic acid disodium, or a combination of any thereof.

Where the herbicide comprises metolachlor, the metolachlor can comprise S-metolachlor.

Where the herbicide comprises paraquat, the paraquat can comprise paraquat dichloride.

Where the herbicide comprises picloram, the picloram can comprise picloram-potassium.

Where the herbicide comprises pyrithiobac, the pyrithiobac comprises pyrithiobac-sodium.

Where the herbicide comprises quizalofop-ethyl, the quizalofop-ethyl can comprise quizalofop-P-ethyl.

Where the herbicide comprises TCA, the TCA can comprise TCA-sodium.

Where the herbicide comprises thifensulfuron, the thifensulfuron can comprise thifensulfuron-methyl.

Where the herbicide comprises tribenuron, the tribenuron can comprise tribenuron-methyl.

Where the herbicide comprises triclopyr, the triclopyr can comprise triclopyr-butotyl, triclopyr-triethylammonium, or a combination thereof.

The herbicide can comprise S-metolachlor and atrazine.

Where the pesticide comprises a fungicide, the fungicide can comprise azoxystrobin, benzovindiflupyr, bixafen, boscalid, bromuconazole, difenconazole, epoxiconazole, fenpicoxamid, fenpropimorph, fluindapyr, fluopyram, flutriafol, fluxapyroxad, isopyrazam, mancozeb, mandestrobin, mefentrifluconazole, metconazole, metominostrobin, penflufen, penthiopyrad, picoxystrobin, prochloraz, procymidone, propiconazole, prothioconazole, pydiflumetofen, pyraclostrobin, sedaxane, tebuconazole, triadimefon, trifloxystrobin, or a combination of any thereof.

Where the pesticide comprises an insecticide, the insecticide can comprise abamectin, acephate, *Bacillus thuringiensis*, bifenthrin, chlorantraniliprole, chlorpyrifos, clothianidin, cyantraniliprole, cyhalothrin (e.g., gamma-cyhalothrin, lambda-cyhalothrin, or a combination thereof), cypermethrin (e.g., alpha-cypermethrin), dimethoate, esfenvalerate, flubendiamide, fipronil, imidacloprid, propargite, phosmet, thiamethoxam, spinosad, or a combination of any thereof.

Where the enzyme comprises a phenolic acid decarboxylase, the pesticide can comprise a salt of 2,4-D, an ester of 2,4-D, or a combination thereof. For example, the salt of 2,4-D can comprise a primary salt of 2,4-D, a secondary salt of 2,4-D, a tertiary salt of 2,4-D, a quaternary salt of 2,4-D, or a combination of any thereof. The salt of 2,4-D can comprise a dimethylammonium salt, a diolamine salt, a trolamine salt, a monomethylamine salt, a choline salt, or a combination of any thereof. The ester of 2,4-D can comprise a butotyl, butyl, isooctyl, or isopropyl ester, a quaternary salt, or a combination of any thereof, Where the enzyme comprises a phenolic acid decarboxylase or a monooxygenase, the pesticide can comprise chlorothalonil.

IX. Cofactor Regenerating Enzymes

In any of the compositions described herein, or in any of the seeds treated with any of the compositions described herein, the composition can further comprise a cofactor-regenerating enzyme.

Likewise, in any of the methods described herein, the method can further comprise the use of a cofactor-regenerating enzyme. Thus, where the method comprises a method for detoxifying an auxin herbicide or degrading an auxin plant growth regulator, the method can further comprise contacting the auxin herbicide or auxin plant growth regulator with a co-factor regenerating enzyme.

Where the method comprises a method for decontaminating a surface of an apparatus used in agriculture or pesticide manufacturing, wherein the surface is contaminated with the auxin herbicide or the auxin plant growth regulator, the method can further comprise contacting the surface with a cofactor-regenerating enzyme.

Where the method comprises a method for decontaminating water, soil, soilless media, or sludge, wherein the water, soil, soilless media, or sludge is contaminated with the auxin herbicide or the auxin plant growth regulator, the method can further comprise contacting the water, soil, soilless media, or sludge with a cofactor-regenerating enzyme.

Where the method comprises a method for a method for protecting a plant from the auxin herbicide, for improving a plant's tolerance for the auxin herbicide, or for removing the auxin herbicide from a surface of a plant, the method can further comprise applying a cofactor-regenerating enzyme to the plant, plant seed, plant growth medium, or area surrounding the plant.

Cofactor-regenerating enzymes can be used to achieve a continuous recycling of the cofactor used by the detoxifying enzyme.

Cofactor-regenerating enzymes are particularly suitable for use with monooxygenases, which require a cofactor (NADPH, NADP+, FADP+, NADH, NAD+, or FADPH) to carry out their enzymatic activity.

Reduced nicotinamide adenine dinucleotide phosphate (NADPH) is an electron donor for many of the enzymatic reactions involved in the selective degradation of target herbicides, for example, monooxygenases that can be used to degrade various auxin herbicides, including 2,4-D and dicamba.

Suitable enzymes for use in the regeneration of NADP and NADPH are known in the art and described in more detail by Weckbecker and Hummel, *Glucose Dehydrogenase for the Regeneration of NADPH and NADH*, in METHODS IN BIOTECHNOLOGY 17 (J. L. Barredo, ed., 2016), the contents of which are incorporated herein by reference in their entirety. For example, specific cofactor regenerating enzymes, such as glucose dehydrogenase (GDH), hexokinase, alcohol dehydrogenases (ADH), and glucose oxidase, can be used with the detoxifying enzymes described herein to replenish NADPH, NADP, FADH, or other cofactors. Cofactor-regenerating enzymes for use in the recycling of NADH or NADPH include, for example: glucose dehydrogenases (GDH), more specifically NADP+-dependent glucose dehydrogenase, Nicotine Adenine Dinucleotide (Phosphate)-dependent glucose dehydrogenases (NAD(P)-GDH), and Flavin-Adenine-Dinucleotide-dependent glucose dehydrogenases (FADGH). Additional cofactor-regenerating enzymes include: alcohol dehydrogenases, sorbitol dehydrogenases, glucose dehydrogenase, glucose oxidases, and hexokinases. These enzymes can be added co-currently with their substrates to provide an environment for recycling the detoxifying compositions. While some GDHs utilize the cofactor nicotine adenine dinucleotide (NAD) or nicotine adenine dinucleotide phosphate (NADP), other GDHs correspond to redox enzymes and utilize other electron acceptors such as flavin adenine dinucleotide (FAD) as the cofactor. In addition, specific GDHs have been selected for use in NADPH regeneration or NADPH recycling reactions that can utilize versatile cofactors, such as either NAD or FAD (Spaans et al., *NADPH-generating systems in bacteria and archaea*, FRONTIERS IN MICROBIOLOGY 6:1-27 (2015), the contents of which are incorporated herein by reference in their entirety).

NADPH recycling can use a NAD(+P) with a GDH that is glucose specific. However, other NAD(+P) with GDHs are useful for recycling the detoxifying compositions are also active toward galactose, xylose, fructose, as well as disaccharides (for example, maltose) and oligosaccharides.

A general reaction for NADPH regeneration is:

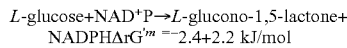
NADPHArG'$^m$ =−2.4+2.2 kJ/mol

Glucose dehydrogenase (GDH) is an oxidoreductase and when added in combination with glucose or another suitable substrate/co-substrate to the compositions comprising the detoxifying enzymes described herein can provide an enzyme recycling system that is used to generate NADPH. A useful enzyme for the regeneration of NADPH and enzyme recycling is glucose dehydrogenase [EC 1.1.1.47], which catalyzes the direct oxidation of glucose into gluconolactone. NADP+-dependent glucose dehydrogenase catalyzes the oxidation of β-D-glucose to D-glucono-1,5-lactone with the simultaneous reduction of the cofactor NADP+ to NADPH or, to a lesser extent, NAD+ to NADH. The enzymatic reaction catalyzed by NADP+-dependent glucose dehydrogenase is shown below:

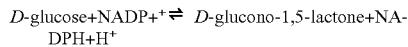

Another useful enzyme for the regeneration of NADPH is glucose-1-dehydrogenase [NAD(P) GDH, EC 1.1.1.118; EC 1.1.1.1.199], which catalyzes the oxidation of the first hydroxyl group of glucose, using NAD+ or NADP+ as the primary electron acceptor. This enzyme has the systemic name B-D-glucose: NAD(P)+1-oxidoreductase. Unlike other GDHs, the cofactor of this enzyme [NAD(P)] is not in bound form to the GDH enzyme. NADP-dependent GDH enzymes are essentially water-soluble cytosolic proteins and forms a complex with NADP and glucose. The enzymatic reaction catalyzed by glucose-1-dehydrogenase is shown below:

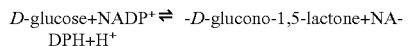

Yet another useful enzyme for the regeneration of NADPH Flavin-Adenine-Dinucleotide(FAD)-Dependent GDHs [FAD GDH, EC 1.1.99.10], which comprises a group of oxidoreductases that can catalyze the oxidation of first hydroxyl group of glucose and other sugar molecules, utilizing FAD as the primary electron acceptor. FAD GDHs utilize a variety of external electron acceptors and are provided with alternative systemic names: D-glucose:acceptor 1-oxidoreductase, glucose dehydrogenase (*Aspergillus*), glucose dehydrogenase (decarboxylating), and D-glucose:(acceptor) 1-oxidoreductase. This enzyme participates in pentose phosphate pathway. It employs one cofactor, FAD. The enzymatic reaction catalyzed by FAD GDH is shown below:

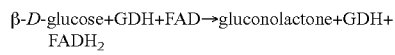

Native bacterial FAD GDH has broad substrate specificity, catalyzing the oxidation of glucose and disaccharides, such as maltose, to their corresponding lactones. Notably, the GDH enzymes, such as NAD(P) GDH occur in a variety of *Bacillus* organisms. Of particular utility are *Bacillus megaterium* and *Bacillus subtilis*, for isolation and production on a commercial scale (Weckbecker and Hummel, 2016). Likewise, FAD GDHs have been successfully expressed in the periplasm of gram-negative bacteria (for example, *Burkholderia cepacia*) and can be produced on a commercial scale.

The GDHs as described herein are provided in addition to glucose and other preferred substrates for use to regenerate NADPH.

In addition to or as an alternative to using the GDHs as described to regenerate the NADPH cofactor, alcohol dehydrogenases (ADH), which is classified as an oxidoreductase can be employed as well for this purpose. Alcohol dehydrogenases (EC 1.1.1.1) are a group of dehydrogenase enzymes that occur in many organisms and facilitate the interconversion between alcohols and aldehydes or ketones with the reduction of nicotinamide adenine dinucleotide (NAD to NADH). ADH for use in the regeneration of NADPH can use methanol or ethanol as a substrate in this reaction. A sample reaction is as follows: An oxidoreductase that reversibly converts an alcohol to an aldehyde (or ketone) with NAD+ as the hydride acceptor; for example, ethanol+NAD+⇌ acetaldehyde+NADH.

In order to maximize cofactor regeneration, the cofactor-regenerating enzymes can be immobilized on a matrix, support, or particle.

For cofactor regeneration to be economical and practical several requirements should preferably be met. First, the total number of moles of product formed per mole of cofactor during the course of the complete reaction should remain sufficiently adequate to provide an effective enzyme concentration applied to a contaminated surface material for the purpose of decontamination. The ratio of the cofactor consumed by the detoxifying compositions compared to the end product produced (referred to as turnover) is determined by the concentration and degradation of the cofactor over time. Additionally, the availability of the resupply of cofactors for regenerating the detoxifying compositions (enzymes) are provided to the detoxifying enzymes of the invention and provide for a kinetically and a thermodynamically favorable use.

In any of the compositions, methods, or seeds described herein, the cofactor-regenerating enzyme can comprise a glucose dehydrogenase (GDH), a hexokinase, an alcohol dehydrogenase (ADH), a glucose oxidase, a sorbitol dehydrogenase, a formate dehydrogenase, a glucose-6-phosphate dehydrogenase, a glutamate dehydrogenase, an acetate kinase, a phosphotransacetylase, an aryl sulfotransferase, a malate dehydrogenase, a lactate dehydrogenase, or a combination of any thereof.

For example, the cofactor-regenerating enzyme can comprise a glucose dehydrogenase, an alcohol dehydrogenase, a formate dehydrogenase, an acetate kinase, a sorbitol dehydrogenase, or a combination of any thereof.

The cofactor-regenerating enzyme can comprise a glucose dehydrogenase, a sorbitol dehydrogenase, an alcohol dehydrogenase, or a combination of any thereof.

For ease of reference, amino acid sequences for illustrative cofactor-regenerating enzymes that can be used in connection with the compositions, seeds, and methods described herein are provided in Table 8 below, together with their SEQ ID NOs.

TABLE 8

Amino acid sequences for cofactor-regenerating enzymes

| Enzyme | SEQ ID NO. for amino acid sequence |
|---|---|
| Formate dehydrogenase (*Escherichia coli*) | 179 |
| Formate dehydrogenase (*Escherichia coli*) | 180 |
| Formate dehydrogenase (*Escherichia coli*) | 181 |
| Formate dehydrogenase (*Bacillus thuringiensis* strain IBL 4222) | 182 |
| Formate dehydrogenase (*Bacillus thuringiensis* serovar huaxhongensis Strain BGSC 4BD1) | 183 |
| Formate dehydrogenase (*Bacillus thuringiensis* sotto strain T04001) | 184 |
| Glucose dehydrogenase (*Escherichia coli*) | 185 |
| Glucose dehydrogenase (*Escherichia coli*) | 186 |
| Glucose dehydrogenase (*Escherichia coli*) | 187 |
| Glucose dehydrogenase (*Bacillus megaterium*) | 188 |
| Glucose dehydrogenase (*Bacillus campisalis*) | 189 |
| Glucose dehydrogenase (*Bacillus thuringiensis* strain BMB171) | 190 |
| Glucose-6-phosphate dehydrogenase (*Escherichia coli*) | 191 |
| Glucose-6-phosphate dehydrogenase (*Escherichia coli*) | 192 |
| Glucose-6-phosphate dehydrogenase (*Escherichia coli*) | 193 |
| Glucose-6-phosphate dehydrogenase (*Bacillus indicus*) | 194 |
| Glucose-6-phosphate dehydrogenase (*Bacillus megaterium*) | 195 |
| Glucose-6-phosphate dehydrogenase (*Bacillus thuringiensis*) | 196 |
| Alcohol dehydrogenase (*Escherichia coli*) | 197 |
| Alcohol dehydrogenase (*Escherichia coli*) | 198 |
| Alcohol dehydrogenase (*Escherichia coli*) | 199 |
| Alcohol dehydrogenase (*Bacillus halodurans* strain C-125) | 200 |
| Alcohol dehydrogenase (*Bacillus licheniformis*) | 201 |
| NADP-dependent isopropanol dehydrogenase (*Bacillus megaterium*) | 202 |
| Glutamate dehydrogenase (*Escherichia coli*) | 203 |
| Glutamate dehydrogenase (*Escherichia coli*) | 204 |
| Glutamate dehydrogenase (*Escherichia coli*) | 205 |
| Glutamate dehydrogenase (*Bacillus halodurans* strain C-125) | 206 |
| Glutamate dehydrogenase (*Bacillus halodurans* strain C-125) | 207 |
| Glutamate dehydrogenase (*Bacillus velezensis*) | 208 |
| Acetate kinase (*Escherichia coli*) | 209 |
| Acetate kinase (*Escherichia coli*) | 210 |
| Acetate kinase (*Escherichia coli*) | 211 |
| Acetate kinase (*Bacillus halodurans* strain C-125) | 212 |
| Acetate kinase (*Bacillus indicus*) | 213 |
| Acetate kinase (*Bacillus sporothemodurans*) | 214 |
| Phosphotransacetylase (*Escherichia coli*) | 215 |
| Phosphotransacetylase (*Escherichia coli* O157: H7 strain Sakai) | 216 |
| Phosphotransacetylase (*Bacillus thuringiensis* serovar kurstaki strain YBT-1520) | 217 |
| Phosphotransacetylase (*Bacillus clausii* strain KSM-K16) | 218 |
| Aryl sulfotransferase (*Escherichia coli*) | 219 |
| Sorbitol dehydrogenase (*Ovis aries*) | 220 |
| L-Glutamic dehydrogenase (*Bos taurus*) | 221 |
| L-Glutamic (NADP) dehydrogenase (*Candida utilis*) | 222 |
| Alcohol dehydrogenase (*Saccharomyces cerevisiae*) | 223 |
| Malate dehydrogenase (MDH1) (*Sus scrofa*) | 224 |
| Sorbitol dehydrogenase (*Bacillus subtilis*) | 287 |
| GutB Sorbitol Dehydrogenase (*Bacillus subtilis* strain 168) | 288 |
| ldh Lactate Dehydrogenase (*Bacillus subtilis* strain 168) | 291 |
| Lactate dehydrogenase (*Bacillus subtilis*) | 292 |
| Lactate dehydrogenase (*Bacillus subtilis*) | 293 |

Where the cofactor regenerating enzyme comprises a formate dehydrogenase, the formate dehydrogenase can comprise an amino acid sequence having at least 70% identity to any one of SEQ ID NOs. 179-184.

The formate dehydrogenase can comprise an amino acid sequence having at least 75% identity to any one of SEQ ID NOs. 179-184.

The formate dehydrogenase can comprise an amino acid sequence having at least 80% identity to any one of SEQ ID NOs. 179-184.

The formate dehydrogenase can comprise an amino acid sequence having at least 85% identity to any one of SEQ ID NOs. 179-184.

The formate dehydrogenase can comprise an amino acid sequence having at least 90% identity to any one of SEQ ID NOs. 179-184.

The formate dehydrogenase can comprise an amino acid sequence having at least 95% identity to any one of SEQ ID NOs. 179-184.

The formate dehydrogenase can comprise an amino acid sequence having at least 98% identity to any one of SEQ ID NOs. 179-184.

The formate dehydrogenase can comprise an amino acid sequence having at least 99% identity to any one of SEQ ID NOs. 179-184.

The formate dehydrogenase can comprise an amino acid sequence having 100% identity to any one of SEQ ID NOs. 179-184.

Where the cofactor regenerating enzyme comprises a glucose dehydrogenase, the glucose dehydrogenase can comprise an amino acid sequence having at least 70% identity to any one of SEQ ID NOs. 185-190.

The glucose dehydrogenase can comprise an amino acid sequence having at least 75% identity to any one of SEQ ID NOs. 185-190.

The glucose dehydrogenase can comprise an amino acid sequence having at least 80% identity to any one of SEQ ID NOs. 185-190.

The glucose dehydrogenase can comprise an amino acid sequence having at least 85% identity to any one of SEQ ID NOs. 185-190.

The glucose dehydrogenase can comprise an amino acid sequence having at least 90% identity to any one of SEQ ID NOs. 185-190.

The glucose dehydrogenase can comprise an amino acid sequence having at least 95% identity to any one of SEQ ID NOs. 185-190.

The glucose dehydrogenase can comprise an amino acid sequence having at least 98% identity to any one of SEQ ID NOs. 185-190.

The glucose dehydrogenase can comprise an amino acid sequence having at least 99% identity to any one of SEQ ID NOs. 185-190.

The glucose dehydrogenase can comprise an amino acid sequence having 100% identity to any one of SEQ ID NOs. 185-190.

Where the cofactor regenerating enzyme comprises a glucose-6-phosphate dehydrogenase, the glucose-6-phosphate dehydrogenase can comprise an amino acid sequence having at least 70% identity to any one of SEQ ID NOs. 191-196.

The glucose-6-phosphate dehydrogenase can comprise an amino acid sequence having at least 75% identity to any one of SEQ ID NOs. 191-196.

The glucose-6-phosphate dehydrogenase can comprise an amino acid sequence having at least 80% identity to any one of SEQ ID NOs. 191-196.

The glucose-6-phosphate dehydrogenase can comprise an amino acid sequence having at least 85% identity to any one of SEQ ID NOs. 191-196.

The glucose-6-phosphate dehydrogenase can comprise an amino acid sequence having at least 90% identity to any one of SEQ ID NOs. 191-196.

The glucose-6-phosphate dehydrogenase can comprise an amino acid sequence having at least 95% identity to any one of SEQ ID NOs. 191-196.

The glucose-6-phosphate dehydrogenase can comprise an amino acid sequence having at least 98% identity to any one of SEQ ID NOs. 191-196.

The glucose-6-phosphate dehydrogenase can comprise an amino acid sequence having at least 99% identity to any one of SEQ ID NOs. 191-196.

The glucose-6-phosphate dehydrogenase can comprise an amino acid sequence having 100% identity to any one of SEQ ID NOs. 191-196.

Where the cofactor regenerating enzyme comprises an alcohol dehydrogenase, the alcohol dehydrogenase can comprise an amino acid sequence having at least 70% identity to any one of SEQ ID NOs. 197-202 and 223.

The alcohol dehydrogenase can comprise an amino acid sequence having at least 75% identity to any one of SEQ ID NOs. 197-202 and 223.

The alcohol dehydrogenase can comprise an amino acid sequence having at least 80% identity to any one of SEQ ID NOs. 197-202 and 223.

The alcohol dehydrogenase can comprise an amino acid sequence having at least 85% identity to any one of SEQ ID NOs. 197-202 and 223.

The alcohol dehydrogenase can comprise an amino acid sequence having at least 90% identity to any one of SEQ ID NOs. 197-202 and 223.

The alcohol dehydrogenase can comprise an amino acid sequence having at least 95% identity to any one of SEQ ID NOs. 197-202 and 223.

The alcohol dehydrogenase can comprise an amino acid sequence having at least 98% identity to any one of SEQ ID NOs. 197-202 and 223.

The alcohol dehydrogenase can comprise an amino acid sequence having at least 99% identity to any one of SEQ ID NOs. 197-202 and 223.

The alcohol dehydrogenase can comprise an amino acid sequence having 100% identity to any one of SEQ ID NOs. 197-202 and 223.

Where the cofactor regenerating enzyme comprises a glutamate dehydrogenase, the glutamate dehydrogenase can comprise an amino acid sequence having at least 70% identity to any one of SEQ ID NOs. 203-208, 221, and 222.

The glutamate dehydrogenase can comprise an amino acid sequence having at least 75% identity to any one of SEQ ID NOs. 203-208, 221, and 222.

The glutamate dehydrogenase can comprise an amino acid sequence having at least 80% identity to any one of SEQ ID NOs. 203-208, 221, and 222.

The glutamate dehydrogenase can comprise an amino acid sequence having at least 85% identity to any one of SEQ ID NOs. 203-208, 221, and 222.

The glutamate dehydrogenase can comprise an amino acid sequence having at least 90% identity to any one of SEQ ID NOs. 203-208, 221, and 222.

The glutamate dehydrogenase can comprise an amino acid sequence having at least 95% identity to any one of SEQ ID NOs. 203-208, 221, and 222.

The glutamate dehydrogenase can comprise an amino acid sequence having at least 98% identity to any one of SEQ ID NOs. 203-208, 221, and 222.

The glutamate dehydrogenase can comprise an amino acid sequence having at least 99% identity to any one of SEQ ID NOs. 203-208, 221, and 222.

The glutamate dehydrogenase can comprise an amino acid sequence having 100% identity to any one of SEQ ID NOs. 203-208, 221, and 222.

Where the cofactor regenerating enzyme comprises an acetate kinase, the acetate kinase can comprise an amino acid sequence having at least 70% identity to any one of SEQ ID NOs. 209-214.

The acetate kinase can comprise an amino acid sequence having at least 75% identity to any one of SEQ ID NOs. 209-214.

The acetate kinase can comprise an amino acid sequence having at least 80% identity to any one of SEQ ID NOs. 209-214.

The acetate kinase can comprise an amino acid sequence having at least 85% identity to any one of SEQ ID NOs. 209-214.

The acetate kinase can comprise an amino acid sequence having at least 90% identity to any one of SEQ ID NOs. 209-214.

The acetate kinase can comprise an amino acid sequence having at least 95% identity to any one of SEQ ID NOs. 209-214.

The acetate kinase can comprise an amino acid sequence having at least 98% identity to any one of SEQ ID NOs. 209-214.

The acetate kinase can comprise an amino acid sequence having at least 99% identity to any one of SEQ ID NOs. 209-214.

The acetate kinase can comprise an amino acid sequence having 100% identity to any one of SEQ ID NOs. 209-214.

Where the cofactor regenerating enzyme comprises a phosphotransacetylase, the phosphotransacetylase can comprise an amino acid sequence having at least 70% identity to any one of SEQ ID NOs. 215-218.

The phosphotransacetylase can comprise an amino acid sequence having at least 75% identity to any one of SEQ ID NOs. 215-218.

The phosphotransacetylase can comprise an amino acid sequence having at least 80% identity to any one of SEQ ID NOs. 215-218.

The phosphotransacetylase can comprise an amino acid sequence having at least 85% identity to any one of SEQ ID NOs. 215-218.

The phosphotransacetylase can comprise an amino acid sequence having at least 90% identity to any one of SEQ ID NOs. 215-218.

The phosphotransacetylase can comprise an amino acid sequence having at least 95% identity to any one of SEQ ID NOs. 215-218.

The phosphotransacetylase can comprise an amino acid sequence having at least 98% identity to any one of SEQ ID NOs. 215-218.

The phosphotransacetylase can comprise an amino acid sequence having at least 99% identity to any one of SEQ ID NOs. 215-218.

The phosphotransacetylase can comprise an amino acid sequence having 100% identity to any one of SEQ ID NOs. 215-218.

Where the cofactor regenerating enzyme comprises an aryl sulfotransferase, the aryl sulfotransferase can comprise an amino acid sequence having at least 70% identity to SEQ ID NO: 219.

The aryl sulfotransferase can comprise an amino acid sequence having at least 75% identity to SEQ ID NO: 219.

The aryl sulfotransferase can comprise an amino acid sequence having at least 80% identity to SEQ ID NO: 219.

The aryl sulfotransferase can comprise an amino acid sequence having at least 85% identity to SEQ ID NO: 219.

The aryl sulfotransferase can comprise an amino acid sequence having at least 90% identity to SEQ ID NO: 219.

The aryl sulfotransferase can comprise an amino acid sequence having at least 95% identity to SEQ ID NO: 219.

The aryl sulfotransferase can comprise an amino acid sequence having at least 98% identity to SEQ ID NO: 219.

The aryl sulfotransferase can comprise an amino acid sequence having at least 99% identity to SEQ ID NO: 219.

The aryl sulfotransferase can comprise an amino acid sequence having 100% identity to SEQ ID NO: 219.

Where the cofactor regenerating enzyme comprises a sorbitol dehydrogenase, the sorbitol dehydrogenase can comprise an amino acid sequence having at least 70% identity to any one of SEQ ID NOs. 220, 287, and 288.

The sorbitol dehydrogenase can comprise an amino acid sequence having at least 75% identity any one of SEQ ID NOs. 220, 287, and 288.

The sorbitol dehydrogenase can comprise an amino acid sequence having at least 80% identity to any one of SEQ ID NOs. 220, 287, and 288.

The sorbitol dehydrogenase can comprise an amino acid sequence having at least 85% identity to any one of SEQ ID NOs. 220, 287, and 288.

The sorbitol dehydrogenase can comprise an amino acid sequence having at least 90% identity to any one of SEQ ID NOs. 220, 287, and 288.

The sorbitol dehydrogenase can comprise an amino acid sequence having at least 95% identity to any one of SEQ ID NOs. 220, 287, and 288.

The sorbitol dehydrogenase can comprise an amino acid sequence having at least 98% identity to any one of SEQ ID NOs. 220, 287, and 288.

The sorbitol dehydrogenase can comprise an amino acid sequence having at least 99% identity to any one of SEQ ID NOs. 220, 287, and 288.

The sorbitol dehydrogenase can comprise an amino acid sequence having 100% identity to any one of SEQ ID NOs. 220, 287, and 288.

The sorbitol dehydrogenase can comprise SEQ ID NO: 288.

Where the cofactor regenerating enzyme comprises a malate dehydrogenase, the malate dehydrogenase can comprise an amino acid sequence having at least 70% identity to SEQ ID NO: 224.

The malate dehydrogenase can comprise an amino acid sequence having at least 75% identity to SEQ ID NO: 224.

The malate dehydrogenase can comprise an amino acid sequence having at least 80% identity to SEQ ID NO: 224.

The malate dehydrogenase can comprise an amino acid sequence having at least 85% identity to SEQ ID NO: 224.

The malate dehydrogenase can comprise an amino acid sequence having at least 90% identity to SEQ ID NO: 224.

The malate dehydrogenase can comprise an amino acid sequence having at least 95% identity to SEQ ID NO: 224.

The malate dehydrogenase can comprise an amino acid sequence having at least 98% identity to SEQ ID NO: 224.

The malate dehydrogenase can comprise an amino acid sequence having at least 99% identity to SEQ ID NO: 224.

The malate dehydrogenase can comprise an amino acid sequence having 100% identity to SEQ ID NO: 224.

When the cofactor regenerating enzyme comprises a lactate dehydrogenase, the lactate dehydrogenase can comprise an amino acid sequence having at least 70% identity to any one of SEQ ID NOs. 291-293.

The lactate dehydrogenase can comprise an amino acid sequence having at least 80% identity to any one of SEQ ID NOs. 291-293.

The lactate dehydrogenase can comprise an amino acid sequence having at least 85% identity to any one of SEQ ID NOs. 291-293.

The lactate dehydrogenase can comprise an amino acid sequence having at least 90% identity to any one of SEQ ID NOs. 291-293.

The lactate dehydrogenase can comprise an amino acid sequence having at least 95% identity to any one of SEQ ID NOs. 291-293.

The lactate dehydrogenase can comprise an amino acid sequence having at least 98% identity to any one of SEQ ID NOs. 291-293.

The lactate dehydrogenase can comprise an amino acid sequence having at least 99% identity to any one of SEQ ID NOs. 291-293.

The lactate dehydrogenase can comprise an amino acid sequence having 100% identity to any one of SEQ ID NOs. 291-293.

Where the cofactor regenerating enzyme comprises an alcohol dehydrogenase, the alcohol dehydrogenase can comprise an NADP-dependent isopropanol dehydrogenase.

The NADP-dependent isopropanol dehydrogenase can comprise an amino acid sequence having at least 70% identity to SEQ ID NO: 202.

The NADP-dependent isopropanol dehydrogenase can comprise an amino acid sequence having at least 75% identity to SEQ ID NO: 202.

The NADP-dependent isopropanol dehydrogenase can comprise an amino acid sequence having at least 80% identity to SEQ ID NO: 202.

The NADP-dependent isopropanol dehydrogenase can comprise an amino acid sequence having at least 85% identity to SEQ ID NO: 202.

The NADP-dependent isopropanol dehydrogenase can comprise an amino acid sequence having at least 90% identity to SEQ ID NO: 202.

The NADP-dependent isopropanol dehydrogenase can comprise an amino acid sequence having at least 95% identity to SEQ ID NO: 202.

The NADP-dependent isopropanol dehydrogenase can comprise an amino acid sequence having at least 98% identity to SEQ ID NO: 202.

The NADP-dependent isopropanol dehydrogenase can comprise an amino acid sequence having at least 99% identity to SEQ ID NO: 202.

The NADP-dependent isopropanol dehydrogenase can comprise an amino acid sequence having 100% identity to SEQ ID NO: 202.

Where the cofactor regenerating enzyme comprises a glucose dehydrogenase, the glucose dehydrogenase can comprise a NADP+-dependent glucose dehydrogenase, a nicotine adenine dinucleotide (Phosphate)-dependent glucose dehydrogenase (NAD(P)-GDH), a flavin-adenine-dinucleotide-dependent glucose dehydrogenase (FADGH), or a combination of any thereof.

The cofactor-regenerating enzyme is suitably capable of regenerating a cofactor selected from the group consisting of NADP+, NADPH, FAD+, FADH, NAD+, NADH, a nucleotide sugar, S-adenosyl methionine (SAM), ATP, coenzyme A (CoA), 3'-phosphoadenosine-5'-phosphosulfate (PAPS), a flavin, pyridoxal phosphate, biotin, a metal porphyrin complex, and combinations of any thereof.

Preferably, the cofactor-regenerating enzyme is capable of regenerating a cofactor selected from the group consisting of NADP+, NADPH, NAD+, NADH, and combinations of any thereof.

Where the composition comprises a cofactor-regenerating enzyme, the composition preferably also comprises a substrate for the cofactor-regenerating enzyme.

Likewise, where the method comprises the use of a cofactor-regenerating enzyme, a substrate for the method preferably comprises using a substrate for the cofactor-regenerating enzyme together with the cofactor-regenerating enzyme.

For example, the substrate for the cofactor-regenerating enzyme can comprise a monosaccharide (e.g., glucose, glucose-6-phosphate, fructose, or a combination thereof), an alcohol, a sugar alcohol (e.g., sorbitol), formate, glutamate, acetate, acetyl-CoA, a sulfate (e.g., p-nitrophenyl sulfate), malate, lactate, or a combination of any thereof.

The alcohol can comprise methanol, ethanol, isopropanol, propanol, hexan-1-ol, pentan-1-ol, or a combination of any thereof.

Where the cofactor-regenerating enzyme comprises a glutamate dehydrogenase, the substrate suitably comprises glutamate.

Where the cofactor-regenerating enzyme comprises a formate dehydrogenase, the substrate suitably comprises formate.

Where the cofactor-regenerating enzyme comprises a glucose dehydrogenase, the substrate suitably comprises glucose.

Where the cofactor-regenerating enzyme comprises an acetate kinase, the substrate suitably comprises acetate.

Where the cofactor-regenerating enzyme comprises a phosphotransacetylase, the substrate suitably comprises acetyl-CoA.

Where the cofactor-regenerating enzyme comprises a hexokinase, the substrate suitably comprises a hexose.

Where the cofactor-regenerating enzyme comprises a glucose oxidase, the substrate suitably comprises glucose.

Where the cofactor-regenerating enzyme comprises a sorbitol dehydrogenase, the substrate suitably comprises sorbitol.

Where the cofactor-regenerating enzyme comprises an alcohol dehydrogenase, the substrate suitably comprises an alcohol.

Where the cofactor-regenerating enzyme comprises a glucose-6-phosphate dehydrogenase, the substrate suitably comprises glucose-6-phosphate.

Where the cofactor-regenerating enzyme comprises an aryl sulfotransferase, the substrate suitably comprises a sulfate.

Where the cofactor-regenerating enzyme comprises a lactate dehydrogenase, the substrate suitably comprises lactate.

Where the cofactor-regenerating enzyme comprises an NADP-dependent isopropanol dehydrogenase, the substrate suitably comprises isopropanol, propanol, hexan-1-ol, pentan-1-ol, or a combination of any thereof.

X. Colorimetric Detection Agents

Colorimetric detection agents can be used in connection with the compositions, seeds, and methods described herein to detect the presence or absence of, or monitor the detoxification or degradation of, an auxin herbicide or auxin plant growth regulator.

In any of the compositions described herein, the composition can further comprise a colorimetric detection agent.

In any of the methods for detoxifying an auxin herbicide or degrading an auxin plant growth regulator described herein, the method can further comprise contacting the auxin herbicide or auxin plant growth regulator with a colorimetric detection agent.

In any of the methods for decontaminating a surface described herein, the method can further comprise contacting the surface with a colorimetric detection agent.

In any of the methods for decontaminating soil, soilless media, water, or sludge described herein, the method can further comprise contacting the water, soil, soilless media, or sludge with a colorimetric detection agent.

In any of the methods described herein for protecting a plant from an auxin herbicide, for improving a plant's tolerance for an auxin herbicide, or for removing an auxin herbicide from a surface of a plant, the method can further comprise applying a colorimetric detection agent to the plant, plant seed, plant growth medium, or area surrounding the plant.

The colorimetric detection agent can be used to visualize detoxification of an auxin herbicide by the enzyme or degradation of an auxin plant growth regulator by the enzyme.

In any of the methods involving the use of a colorimetric detection agent, the method can further comprise detecting a change in the color of the colorimetric detection agent. For example, the change in the color of the colorimetric detection agent can be detected visually, using a spectrophotometric device, or using a color probe. A change in the color of the colorimetric detection agent indicates degradation of the auxin herbicide or auxin plant growth regulator. The change in the color of the colorimetric detection agent can be a change from a colored colorimetric detection agent to a colorless product. Alternatively, the change in the color of the colorimetric detection agent is a change from a colorless colorimetric detection agent to a colored product.

In any of the compositions or methods involving the use of a colorimetric detection agent, the colorimetric detection agent can be a substrate for the chlorohydrolase or the phenolic acid decarboxylase.

Where the colorimetric detection agent is a substrate for the chlorohydrolase or the phenolic acid decarboxylase, the colorimetric detection agent can comprise an azo dye (e.g., 2,2'-azino-bis(3-ethylbenzothiazoline-6-sulphonic acid) (ABTS)), a nitrophenol derivative (e.g., o-nitrophenol, 2,6-dimethoxyphenol, dimethyl-p-phenylenediamine, nitro blue tetrazolium (NBT) chloride, or a combination of any thereof), or a combination thereof.

Alternatively, the composition can comprise an additional enzyme that reacts with and causes a color change in the colorimetric detection agent.

Similarly, where a method comprises the use of a colorimetric detection agent, the method can further comprise providing the colorimetric detection agent together with an additional enzyme that reacts with and causes a color change in the colorimetric detection agent.

The additional enzyme can comprise a laccase, an azoreductase, a ligninase, a peroxidase, an oxidase, β-galactosidase, or a combination thereof.

The additional enzyme preferably comprises a laccase, an azoreductase, or a combination thereof.

Laccases are copper-containing enzymes that catalyze the oxidative conversion of a variety of chemicals, such as mono-, oligo-, and polyphenols and aromatic amines. Laccases act on phenols and similar molecules, performing one-electron oxidations. Laccases can also be described as a benzenediol:oxygen oxidoreductases.

Alternative names for laccases include p-diphenol: dioxygen oxidoreductases (polyphenol oxidase) and urishiol oxidase. The Enzyme Commission (EC) number for laccases is 1.10.3.2

Laccases have the ability to oxidize a wide variety of organic and inorganic compounds and a broad range of phenolic compounds, which include those that constitute the end products that result from detoxification of auxin herbicides. A comprehensive review for laccase-based biosensors with applications in wastewater treatment, textile pulp and paper and the food industry (estimation of polyphenols in wine and olive oils) is provided in Rodriguez-Delgado et al., *Laccase-based biosensors for detection of phenolic compounds*, TRENDS IN ANALYTICAL CHEMISTRY 74:21-45 (2015), which is incorporated by reference herein in its entirety.

3,6-Dichloro-2-methoxyphenol, which is produced as an end product from the detoxification of dicamba using salicylate monooxygenase, is a substrate for laccase. In the presence of dicamba as a substrate, salicylate monooxygenase reacts as follows:

Dicamba+NADH/NADPH+2H$^+$O$_2$ → 3,6-Dichloro-2-methoxyphenol+NAD$^+$/NADP$^+$H$_2$O+CO$_2$.

3,6-Dichloro-2-methoxyphenol is also referred to as 6-Dichloro-2-methoxyphenol; 2-Methoxy-3,6-dichloro-phenol; or 3,6-dichloroguaiacol (C$_7$H$_6$Cl$_2$O$_2$).

Laccases exist widely in nature. They are predominantly found in higher plants, and recently some bacterial laccases have also been characterized from some species of *Bacillus* and *Streptomyces*. Laccases act on phenols and similar molecules, performing one-electron oxidations. Laccases suitable for use in connection with the compositions, seeds, and methods described herein have broad substrate specificity and an ability to efficiently oxidize and decolorize several colorimetric agents.

Laccases also have the capacity to be reliably produced using large scale batch production. Properties and applications using laccases that function in the decolorization of dyes are known in the art (Madhavi and Lele, *Laccase: Properties and Applications*, BIORESOURCES 4(4): 1694-171 (2009), incorporated herein by reference in its entirety).

A laccase (e.g., SEQ ID NO: 228 or 229) can be added to any of the compositions described herein or used in any of the methods described herein together with a colorimetric agent (reagent dye or colorant) that will undergo decolorization when laccase is in a catalytically active state. The amount of substrate (e.g., 3,6-Dichloro-2-methoxyphenol) produced is proportionally related to the amount of dicamba that has undergone detoxification using the detoxifying formulation(s) as described herein. The enzyme-induced decontamination assay as described herein using laccase can further provide a visual qualitative estimate of the concentration of an herbicide (e.g., dicamba) remaining in solution. The decolorization of the colorimetric agents or reagent dyes by laccase is proportional to the reactivity of laccase on the end-product substrate (e.g., 3,6-Dichloro-2-methoxyphenol) in the reaction. This assay can be further used to estimate the removal of an herbicide (e.g., dicamba) and is correlated with the generation of a specific end product produced as a result of the selective detoxifying activity on the dicamba herbicide.

A general reaction for laccase is as follows:

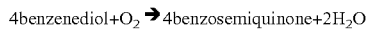
4benzenediol+O$_2$ → 4benzosemiquinone+2H$_2$O

The reduction of oxygen to water is accompanied by the oxidation reaction with a phenolic substrate.

Alternatively, azoreductases can be used in connection with the compositions, seeds, and methods described herein to provide colorimetric detection of herbicide degradation. Azoreductases are enzymes that can cleave azo linkages (—N=N—) in azo dyes, forming aromatic amines. Azoreductases are generally bacterial in origin.

Alternative names for azoreductases include FMN-dependent NADH azoreductase and putative acyl carrier protein phosphodiesterase. The Enzyme Commission (EC) number for azoreductases is 1.7.1.6.

Azoreductases are enzymes that are produced by anaerobic bacteria and can be readily used to decolorize azo dyes by cleavage of the azo linkages (—N=N—) in the azo dyes, forming aromatic amines. Synthetic azo dyes are readily available for use. They are classified as acidic, basic, disperse, azo, diazo, anthroquinone based and metal complex dyes (Robinson et al., *Remediation of dyes in textile effluent: a critical review on current treatment technologies with a proposed alternative*, BIORESOURCE TECHNOLOGY 77:247-255 (2001)). Azo dyes are characterized by the presence of one or more azo groups that act as chromophores, which can associate with aromatic and other groups such as hydroxyls (—OH), chloro (—Cl), methyl (—CH$_3$), nitro (—NO$_2$), amino (—NH$_3$), carboxyl (—COOH) and sulfonic groups (—SO$_3$H) and yield various types of dyes/colorimetric agents used in combination with azoreductases in decoloration reactions for detoxifying/decontaminating pesticides in solution.

For ease of reference, illustrative nucleic acid sequences for laccases and azoreductases that can be used in connection with the compositions, seeds, or methods described herein are provided in Table 9 below. The amino acid sequences for each of the laccases and azoreductases are provided in Table 10 below.

TABLE 9

Nucleotide sequences for Laccases and Azoreductase

| Enzyme (SEQ ID NO) | SEQ ID NO. for nucleotide sequence |
|---|---|
| Laccase (*Bacillus cereus*) | 225 |
| Laccase (*Bacillus cereus*) | 226 |
| Azoreductase (*Bacillus thuringiensis* Strain 4Q7) | 227 |

TABLE 10

Amino Acid sequences for Laccases and Azoreductase

| Enzyme (SEQ ID NO) | SEQ ID NO. for amino acid sequence |
|---|---|
| Laccase (*Bacillus cereus*) | 228 |
| Laccase (*Bacillus cereus*) | 229 |
| Azoreductase (*Bacillus thuringiensis* Strain 4Q7) | 230 |

Where the additional enzyme comprises a laccase, the laccase can comprise an amino acid sequence having at least 70% identity to SEQ ID NO: 228 or 229.

The laccase can comprise an amino acid sequence having at least 75% identity to SEQ ID NO: 228 or 229.

The laccase can comprise an amino acid sequence having at least 80% identity to SEQ ID NO: 228 or 229.

The laccase can comprise an amino acid sequence having at least 85% identity to SEQ ID NO: 228 or 229.

The laccase can comprise an amino acid sequence having at least 90% identity to SEQ ID NO: 228 or 229.

The laccase can comprise an amino acid sequence having at least 95% identity to SEQ ID NO: 228 or 229.

The laccase can comprise an amino acid sequence having at least 98% identity to SEQ ID NO: 228 or 229.

The laccase can comprise an amino acid sequence having at least 99% identity to SEQ ID NO: 228 or 229.

The laccase can comprise an amino acid sequence having 100% identity to SEQ ID NO: 228 or 229.

Where the additional enzyme comprises an azoreductase, the azoreductase can comprise an amino acid sequence having at least 70% identity to SEQ ID NO: 230.

The azoreductase can comprise an amino acid sequence having at least 75% identity to SEQ ID NO: 230.

The azoreductase can comprise an amino acid sequence having at least 80% identity to SEQ ID NO: 230.

The azoreductase can comprise an amino acid sequence having at least 85% identity to SEQ ID NO: 230.

The azoreductase can comprise an amino acid sequence having at least 90% identity to SEQ ID NO: 230.

The azoreductase can comprise an amino acid sequence having at least 95% identity to SEQ ID NO: 230.

The azoreductase can comprise an amino acid sequence having at least 98% identity to SEQ ID NO: 230.

The azoreductase can comprise an amino acid sequence having at least 99% identity to SEQ ID NO: 230.

The azoreductase can comprise an amino acid sequence having 100% identity to SEQ ID NO: 230.

Where the composition comprises an additional enzyme that reacts with and causes a color change in the colorimetric agent, or where the method involves the use of an additional enzyme that reacts with and causes a color change in the colorimetric agent, the colorimetric detection agent can comprise an azo dye (e.g., 2,2'-azino-bis(3-ethylbenzothiazoline-6-sulphonic acid) (ABTS)), a nitrophenol derivative (e.g., o-nitrophenol, 2,6-dimethoxyphenol, dimethyl-p-phenylenediamine, nitro blue tetrazolium (NBT) chloride, or a combination of any thereof), a lignin, syringaldazine, dimethyl-p-phenylenediamine, a polymeric dye (e.g., Poly R-478), phenazine methosulfate, 5-bromo-4-chloro-3-indolyl-β-D-galactopyranoside (X-gal), or a combination of any thereof.

The additional enzymes used for colorimetric detection can be immobilized on a matrix, support, or particle.

Examples of colorimetric detection agents that can be used in enzyme-induced colorimetric decolorization assays include Remazol Brillant Blue R (RBBR) and Poly R-478. Both of these agents contain anthraquinone chromophoric groups. Laccases, which possess ligninolytic activity, can react with these colorimetric agents in solution. Both of these colorimetric agents selected react with laccases because their structures resemble lignin-like components. The laccase, in combination with the colorimetric agent, then functions as a detoxification biosensor to visualize and confirm changes in the detoxification of dicamba or other herbicidal/pesticidal residues.

The reduction of the phenolic end products such as methoxyphenol by laccase provides an estimate or indirect measure for the amount of dicamba residue that has been sufficiently detoxified in the detoxifying formulation solution as indicated by the decoloration reaction with RBBR or Poly-478.

Thus, the detoxifying activity of salicylate monooxygenase on the target herbicide (e.g., dicamba) is associated with the change from a colored solution prior to detoxification to clear solution when dicamba has been sufficiently converted to its non-toxic end products.

A sensitive enzyme-induced decoloration assay is provided using any laccase described herein as a detoxification biosensor for detecting the detoxification of dicamba (or other herbicides of the invention). This assay can also be used to complement or validate conventional analytical methods, for example, standard HPLC or spectrophotometric methods used for detecting a pesticide or herbicide, such as dicamba and its end products.

This enzyme-induced decoloration assay can also be used with any of the detoxifying enzymes of the present invention for example, hydroxyphenylacetate monooxygenase or hydroxybenzoate monooxygenase.

Ligninolytic indicator dyes can also be used as colorimetric detection agents. Ligninolytic indicator dyes and uses in dye decoloration applications are described by Bandonas et al., *Isolation and characterization of novel bacterial strains exhibiting ligninolytic potential*, BMC BIOTECHNOLOGY 11(94): 1-11 (2011), which is incorporated by reference herein in its entirety. Additional ligninolytic indicator dyes are selected from the phenothiazine dye class and comprise Azure B, Methylene Blue, Toluidine Blue O.

XI. Auxin Herbicides and Auxin Plant Growth Regulators

The monooxygenases, phenolic acid decarboxylases, and chlorohydrolases described herein detoxify auxin herbicides and degrade auxin plant growth regulators.

Auxin herbicides are structurally similar to naturally occurring auxins and act by mimicking auxin to change the natural IAA balance in a plant. Auxin herbicides are widely used herbicides in turf, crop, fallow, and grass management (especially for home and golf course use) forest management, brush management in non-cropland sites, and for controlling aquatic weeds.

Auxin herbicides include phenoxy herbicides and benzoic acid herbicides.

Phenoxy herbicides include, but are not limited to, herbicides such as 2,4-dichlorophenoxyacetic acid (2,4-D), 2-methyl-4-chlorophenoxyacetic acid (MCPA), 4-(4-chloro-o-tolyloxy)butyric acid (MCPB), mecoprop, 4-(2,4-dichlorophenoxy)butyric acid (2,4-DB), dichlorprop, dichlorprop-p, mecoprop-p, and salts and esters of any thereof.

2,4-Dichlorophenoxyacetic acid (2,4-D) acts as a systemic herbicide which selectively kills most broadleaf weeds. 2,4-D is available in several chemical forms, including salts, esters, and an acid form and it is often mixed with other herbicides. The toxicity of 2,4-D depends on its form.

Benzoic acid herbicides include dicamba, chloramben, 2,3,6-trichlorobenzoic acid (2,3,6-TBA), and salts, acids, and esters of any thereof.

Dicamba (3,6-dichloro-o-anisic acid or 3,6-dichloro-2-methoxy benzoic acid) is a broad spectrum herbicide that kills broadleaf plants and woody plants.

Dicamba can occur in acid and salt forms. Dicamba salts include but limited to, isopropylamine, diglycoamine, dimethylamine, potassium, sodium, monoethanolamine (MEA), monomethylamine (MMA), and BAPMA (N-N(bis-3-aminopropyl)methylamine) salts.

In addition to degrading dicamba itself, the enzymes can also degrade metabolic products or derivatives of dicamba, including substituted benzoic acids and biologically acceptable salts thereof. Some dicamba metabolites and derivatives have herbicidal activity.

Metabolic derivatives of dicamba include, but are not limited to 6-dichlorosalicyclic acid (3,6-DCSA), dichloro gibberellic acid (DCGA), and dichlorogentisic acid (DC-gentisic acid).

Various formulations containing dicamba, 2,4-D, and/or other auxin herbicides are commercially available. Table 11 below lists the active ingredients in illustrative commercially available formulations.

TABLE 11

Illustrative commercially available formulations of auxin herbicides.
Active Ingredients Dicamba
2,4-D, dimethylamine salt; Dicamba, dimethylamine salt
Dicamba, dimethylamine salt
Atrazine; Dicamba, potassium salt
2,4-D, 2-ethylhexyl ester; 2,4-DP-p, 2-ethylhexyl ester; Dicamba
Dicamba, sodium salt; Diflufenzopyr-sodium; Nicosulfuron
Dicamba, diglycolamine salt
Dicamba; MCPA, 2-ethylhexyl ester; Triclopyr, butoxyethyl ester
Dicamba, sodium salt; Diflufenzopyr-sodium
Dicamba, dimethylamine salt; MCPA, dimethylamine salt; Triclopyr, trimethylamine salt
2,4-D; Dicamba
Dicamba, sodium salt; Primisulfuron-methyl
2,4-D, 2-ethylhexyl ester; Dicamba
Carfentrazone-ethyl; Dicamba; MCPA, 2-ethylhexyl ester; MCPP-p acid
2,4-D, dimethylamine salt; Dicamba; MCPP, dimethylamine salt
Dicamba, diglycolamine salt; Fluroxypyr, 1-methylheptyl ester
2,4-D, dimethylamine salt; Dicamba, dimethylamine salt; Quinclorac; Sulfentrazone
Dicamba, sodium salt; Rimsulfron
2,4-D, 2-ethylhexyl ester; Carfentrazone-ethyl; Dicamba' MCPP-p acid
2,4-D, dimethylamine salt; Dicamba, dimethylamine salt; MCPP-p, dimethylamine salt; Sulfentrazone
2,4-D, dimethylamine salt; Dicamba, dimethylamine salt; MCPP-p, dimethylamine salt;
2,4-D, dimethylamine salt; Dicamba, dimethylamine salt; MCPP-p, dimethylamine salt; MSMA
2,4-D, triisopropanolamine salt; Dicamba; Picloram, triisopropanolamine salt
Dicamba, sodium salt; Halosulfuron-methyl
2,4-D, Pyraflufer ethyl, 2,4-D 2-Ethylhexyl ester
2,4-D acid, Flumioxazin
2,4-D, Dicamba, 2,4-D 2-Ethylhexyl ester, Fluroxypyr
2,4-D, Dicamba, Fluroxypyr For any of the enzymes, compositions, seeds, and methods described herein, the enzyme is capable of detoxifying an auxin herbicide, degrading an auxin plant growth regulator, or a combination thereof.

The enzyme can be capable of detoxifying an auxin herbicide.

The enzyme can be capable of degrading an auxin plant growth regulator.

The auxin herbicide or auxin plant growth regulator can have the structure:

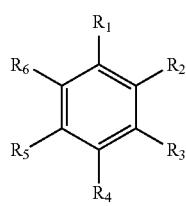
(I)

wherein:
$R_1$ is Cl, H, or $CH_3$,
$R_2$ is Cl, H, carboxyl,

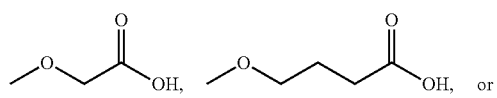

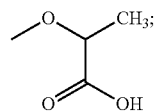
-continued $R_3$ is methoxy, H, carboxyl, $NH_2$, or Cl;
$R_4$ is Cl, $NH_2$, or H;
$R_5$ is Cl, H, or $NH_2$; and
$R_6$ is H, $NH_2$, or Cl.

The auxin herbicide can comprise a benzoic acid herbicide or a phenoxy herbicide.

For example, the auxin herbicide can comprise a benzoic acid herbicide having the structure:

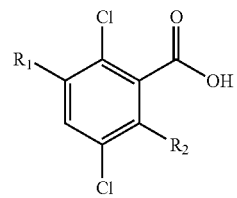
(II)

wherein:
$R_1$ is H or $NH_2$; and
$R_2$ is —O—$CH_3$, Cl, or H.

For example, the benzoic acid herbicide can comprise dicamba, chloramben, 2,3,6-trichlorobenzoic acid (2,3,6-TBA), a salt of any thereof, an ester of any thereof, or a combination of any thereof.

The benzoic acid herbicide can comprise dicamba or a salt thereof.

The dicamba salt can comprise a dimethylamine salt of dicamba, a diglycolamine salt of dicamba, an isopropylamine salt of dicamba, or a combination of any thereof.

For any of the enzymes, compositions, seeds, and methods described herein, the enzyme can be capable of detoxifying or degrading a metabolic product or derivative of dicamba, the metabolic product or derivative comprising 3,6-dichlorosalicyclic acid (3,6-DCSA), dichloro gibberellic acid (DCGA), dichlorogentisic acid (DC-gentisic acid), or a combination of any thereof.

The auxin herbicide can comprise a phenoxy herbicide having the structure:

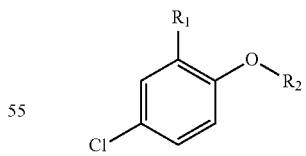
(III)

wherein:
$R_1$ is Cl or $CH_3$; and
$R_2$ is

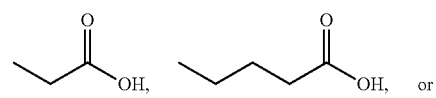

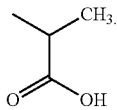

For example, the phenoxy herbicide can comprise 2,4-dichlorophenoxyacetic acid (2,4-D), 2-methyl-4-chlorophenoxyacetic acid (MCPA), 4-(4-chloro-o-tolyloxy)butyric acid (MCPB), mecoprop, 4-(2,4-dichlorophenoxy)butyric acid (2,4-DB), dichlorprop, dichlorprop-p, mecoprop-p, a salt of any thereof, an ester of any thereof, or a combination of any thereof.

The phenoxy herbicide can comprise 2,4-dichlorophenoxyacetic acid (2,4-D), a salt thereof, or an ester thereof.

The salt of 2,4-D can comprise an amine salt.

The ester of 2,4-D can comprise an isooctyl ester, a 2-ethylhexyl ester, or a combination thereof.

The auxin plant growth regulator can comprise indole-3-acetic acid (IAA), indole-3-pyruvic acid, indole-3-acetaldoxime, indole-3-acetamide, indole-3-acetonitrile, indole-3-ethanol, indole-3-pyruvate, indole-3-butyric acid (IBA), a phenylacetic acid, 4-chloroindole-3-acetic acid (4-Cl-IAA), 2-phenylacetic acid (PAA), indole-3-propionic acid (IPA), a naphthaleneacetic acid derivative (e.g., 1-naphthaleneacetic acid (NAA), 1-napthylacetamide (NAD), or a combination thereof), 2,4-dichlorophenoxyacetic acid (2,4-D), dichlorprop, dichlorprop-P, 4-(2,4-dichlorophenoxy) butyric acid (2,4-DB), triclopyr, 2,4-5-trichlorophenoxyacetic acid (2,4,5-T), a glucose-conjugated auxin, or a combination of any thereof.

XII. Types of Seeds and Plants

For any of the treated seeds described herein, the seed can be a seed from a monocotyledon, a dicotyledon, an angiosperm, or a gymnosperm. Likewise, in any of the methods described herein comprises applying an enzyme to a plant or a plant seed, the plant or plant seed can be a monocotyledon, dicotyledon, angiosperm, or gymnosperm plant or seed.

The treated seeds can comprise seeds from any of the plants listed below. Likewise, the plants can be any of the plants listed below.

Examples of plant species of interest include, but are not limited to, corn (*Zea mays*), *Brassica* species (*Brassica napus, Brassica rapa, Brassica juncea*), particularly those *Brassica* species useful as sources of seed oil (also referred to as "canola"), flax (*Linum* spp.), alfalfa (*Medicago sativa*), rice (*Oryza sativa*), rye (*Secale cereale*), sorghum (*Sorghum bicolor, Sorghum vulgare*), millet (pearl millet), proso millet (*Panicum miliaceum*), foxtail millet (*Setaria italica*), finger millet (*Eleusine coracana*), oats (*Avena sativa*), barley (*Hordeum vulgare*), sunflower (*Helianthus annuus*), safflower (*Carthamus tinctorius*), wheat (*Triticum aestivum*), soybean (*Glycine max*), tobacco (*Nicotiana tabacum*), potato (*Solarium tuberosum*), sweet potato (*Ipomoea batatas*), peanuts (*Arachis hypogaea*), cotton (*Gossypium barbadense, Gossypium hirsutum*), cassava (*Manihot esculenta*), coffee (*Coffea* spp.), coconut (*Cocos nucifera*), pineapple (*Ananas comosus*), citrus trees (*Citrus* spp.), cocoa (*Theobroma cacao*), tea (*Camellia sinensis*), banana (*Musa* spp.), avocado (*Persea americana*), fig (*Ficus casica*), guava (*Psidium guajava*), mango (*Mangifera indica*), olive (*Olea europaea*), papaya (*Carica papaya*), cashew (*Anacardium occidentále*), macadamia (*Macadamia integrifolia*), almond (*Prunus amygdalus*), sugar beets (*Beta vulgaris*), sugarcane (*Saccharum* spp.), grains, vegetables, fruits, ornamentals (flowers), sugar cane, conifers, herbs and mushrooms, tomatoes, field peas, lupins, forestry, vines, and eucalytpus.

Plants of interest include vegetables, including, for example, tomatoes (*Lycopersicon esculentum*), lettuce (*Lactuca sativa*), green beans (*Phaseolus vulgaris*), lima beans (*Phaseolus limensis*), peas (*Lathyrus* spp.), and members of the genus *Cucumis* such as cucumber (*Cucumis sativus*), cantaloupe (*Cucumis cantalupensis*), muskmelon and honeydew (*Cucumis melo*), horned cucumber or honed melon (*Cucumis metuliferus*), broccoli (*Brassica oleracea*), Cabbage (*Brassica oleracea*), chili peppers (*Capsicum frutescens*), Kale (*Brassica oleracea*), Onions (*Allium cepa*), Spinach (*Spinacia oleracea*), globe artichoke (*Cynara cardunculus*), Jerusalem artichoke (*Helianthus tuberosus*), Broccoli (*Brassica Oleracea*), Watercress (*Nasturtium officinale*).

Plants of interest also include ornamental plants, including, for example azalea (*Rhododendron* spp.), hydrangea (*Macrophylla hydrangea*), hibiscus (*Hibiscus rosasanensis*), roses (*Rosa* spp.), tulips (*Tulipa* spp.), daffodils (*Narcissus* spp.), petunias (*Petunia hybrida*), carnation (*Dianthus caryophyllus*), poinsettia (*Euphorbia pulcherrima*), chrysanthemum and marigold (*Calendula officinalis*).

Plants of interest further include herb and spice plants, including, for example: antihelmintic herbs such as Basil (*Ocimum basilicum*), Chamomile (*Marticaria recutita, Chamaemelum nobile*), Juniper (*Juniperus communis*), Artemisia (*Artemisia absinthium, Artemisia absinthe*); anti-inflammatory herbs such as Acerola (*Malpighia Emarginata*), Achiote/annatto, Agrimony (*Agrimonia*), Aloe Vera (*Aloe Barbadensis*), Arnica (*Arnica montana*), Beetroot (*Beta vulgaris* L), Bergamot Orange (*Citrus bergamia*), Black Cohosh (*Cimicifuga racemosa*), Borage/starflower (*Borago officinalis*), Cats Claw (*Uncaria tomentosa*), Cayenne (*Capsicum annuum*), Cissus (*Cissus quadrangularis*), Coriander (*Coriandrum sativum*), Devil's Claw (*Harpagophytum procumbens*), Purple Coneflower (*Echinacea purpurea*), Elder plant (*Sambucus*), Eyebright (*Euphrasia rostkoviana, Euphrasia officinalis*), Evening Primrose Oil (*Oenothera biennis*), Feverfew (*Tanacetum parthenium*), Flaxseed (*Linum usitatissimum*), Fo Ti Root (*Fallopia multiflora*), Ganoderma (*Ganoderma lucidum*), Geranium (*Geranium maculatum*), Ginger Root (*Zingiber officinale*), Ginkgo (*Ginkgo biloba*), Ginseng (*Panax ginseng*), Gotu Kola (*Centella asiatica*), Hemp (*Cannabis*), Horse Chestnut (*Aesculus hippocastanum*), Horsetail (*Equisetum*), Lemon Balm/melissa (*Melissa officinalis*), Licorice Root (*Glycyrrhiza glabra*), Marjoram (*Origanum majorana*), Marshmallow (*Althaea*), Milk Thistle (*Silybum marianum*), Mint (*Mentha spicata*), Nettle (*Urtica dioica*), Nutmeg (*Myristica fragrans*), Peppermint (*Mentha×Piperita, Mentha balsamea*), Prickly Pear Cactus (*Opuntia ficus-indica*), Rosemary (*Rosmarinus officinalis*), Sage (*Salvia officinalis*), Sarsaparilla (*Smilax ornata*), Siberian Ginseng (*Eleutherococcus senticosus*), Thyme (*Thymus vulgaris*), Turmeric (*Curcuma longa*), Cumin (*Cuminum cyminum*), Cardamon (*Elettaria, Amomum, Zingiberaceae*) Yarrow (*Achillea millefolium*); Lavender (*Lavendula angustifolia*), Bay laurel (*Laurus nobilis*), Caraway (*Carum carvi*) also known as meridian fennel- or Persian cumin), Catnip (*Nepeta cataria*), Chervil (*Anthriscus cerefolium*), Chives (*Allium schoenoprasum*), Mexican coriander (*Eryngium foetidum*), Chinese parsley (*Heliotropium curassavicum*), and Cilantro (*Coriandrum sativum*), Garlic (*Allium sativum*), Kelp (Phaeophyceae), Black Pepper (*Piper nigrum*), Peppermint (*Mentha×piperita*), Saffron (*Crocus sativus*), Rose hip (*Rosa*), Spearmint (*Mentha spicata*), St. John's Wort (*Hypericum perforatum*), Tarragon (*Artemisia dracunculus*), Wasabi (*Eutrema japonicum*), Allspice (*Pimpinella anisum*), Cayenne (*Cassicum annuum*), Paprika (*Capsicum annuum*), Cinnamon (*Cinnamomum zeylaticum*), Cloves (*Syzgium aromaticum*), Dill (*Anethum graveolens*), Fennel (*Foeniculum vulgare*), Fenugreek (*Trigonella* foenum-graecum), Flaxseed (*Linum usitatissimum*), Green Tea (*Camellia sinensis*), Mace (*Myristica fragrans*), Mustard (*Brassica, Sinapsis*), Vanilla (*Vanilla planifolia, Vanilla pompona*) and other medicinal or nutraceutical plants, such as Jojoba (*Simmondsia chinensis, Simmondsia californica*), Aloe vera (*Aloe vera,* (L)), and Cannabis (*Cannabis sativa*).

Plants of interest also include fruits, including, for example, Blueberry (*Vaccinium corymbosum*), Cherries (*Prunus, Prunus avium*), Grapes (*Vitis vinifera*), Guava (*Psidium guajava*), Pomegranate (*Punica granatum*), Raspberry (*Rubus idaeus, Rubus occidentalis, Rubus idaeus, Rubus strigosus*), Elderberry (*Sambucus*), Goji Berry (*Lycium barbarum*), Hawthorn Berry (*Crateagus oxycanthus*), Blueberries (*Vaccinium corymbosum*), Strawberries (*Fragariax Ananassa*), Bergamont Orange (*Citrus bergamia*) Tangerine (*Citrus tangerina*), Cranberry (*Vaccinium macrocarpon*), Apples (*Malus domestica, Malus Sylvestris* or *Pyrus malus*), Pear (*Pyrus* in the family Rosaceae), Peach (*Prunus persica*), Plums (*Prunus domestica*), Avocado (*Persea americana*), Orange (*Citrus×sinensis*), Grapefruit (*Citrus×Paradisi*), tangarine, lemon (*Citrus×limon*), lime (*Citrus latifoli, Citrus aurantifolia*), Coconut, Tomato (*Solanum lycopersicum*), and Nicotine (Nightshade).

Plants of interest also include trees, including, for example, conifers such as pines such as loblolly pine (*Pinus taeda*), slash pine (*Pinus elliotii*), *ponderosa* pine (*Pinus ponderosa*), lodgepole pine (*Pinus contorta*), and Monterey pine (*Pinus radiaa*), Douglas-fir (*Pseudotsuga menziesii*), Western hemlock (*Tsuga canadensis*), Sitka spruce (*Picea glauca*), redwood (*Sequoia sempervirens*), true firs such as silver fir (*Abies amabilis*) and balsam fir (*Abies balsamea*), and cedars such as Western red cedar (*Thuja plicata*) and Alaska yellow-cedar (*Chamaecyparis nootkatensis*) and Juniper (*Juniperus communis*). Other trees of interest include hardwood trees, including, for example, almonds, ash, aspen, beech, basswood, birch, black cherry, black walnut, buckeye, American chestnut, cottonwood, coffee (Cocoa), dogwood, elm, hackberry, hickory, holly, locust, *magnolia*, maple, oak, olive, *magnolia*, poplar, yellow-poplar, red alder, redbud, royal *paulownia, sassafras*, sweet-gum, sycamore, tupelo, walnut, and willow; palm trees (family Palmae), *Eucalyptus* (*Eucalyptus*), and *Paulownia* trees.

Grains, oil seed, and leguminous plants are of particular interest, including for example corn, alfalfa, sunflower, *Brassica*, soybean, legumes, cotton, safflower, sugar cane, peanut, sorghum, wheat, barley, millet, rice, rye, palm, coconut and tobacco.

Leguminous plants of interest include but are not limited to beans and peas. Beans include guar, locust bean, fenugreek, soybean, garden beans, cowpea, mungbean, lima bean, *faba* bean, fava bean, lentils, chickpea, feijoa, dry beans, etc.

Other plants of interest include turfgrasses such as, for example, turfgrasses from the genus *Poa, Agrostis, Festuca, Lolium,* and *Zoysia*. Additional turfgrasses can come from the subfamily Panicoideae. Turfgrasses can further include, but are not limited to, Blue gramma (*Bouteloua gracilis,* (H.B.K.) Lag. Ex Griffiths), Buffalograss (*Buchloe dactyloids* (Nutt.) Engelm.), Slender creeping red fescue (*Festuca rubra* ssp. *litoralis*), Red fescue (*Festuca rubra*); Colonial bentgrass (*Agrostis tenuis* Sibth.); Creeping bentgrass (*Agrostis palustris* Huds.); Fairway wheatgrass (*Agropyron cristatum* (L.) Gaertn.); Hard fescue (*Festuca longifolia* Thuill.); Kentucky bluegrass (*Poa pratensis* L.); Perennial ryegrass (*Lolium perenne* L.); Rough bluegrass (*Poa trivialis* L.), Sideoats grama (*Bouteloua curtipendula* Michx. Torr.), Smooth bromegrass (*Bromus inermis* Leyss.), Tall fescue (*Festuca arundinacca* Schreb.), Annual bluegrass (*Poa annua* L.), Annual ryegrass (*Lolium multiflorum* Lam.), Redtop (*Agrostis alba* L.), Japanese lawn grass (*Zoysia japonica*), bermudagrass (*Cynodon dactylon, Cynodon* spp. L. C. Rich, (*Cynodon transsvaalensis*), Seashore *paspalum* (*Paspalum vaginatum* Swartz), Zoysiagrass (*Zoysia* spp. Willd. *Zoysia japonica* and *Z. matrella* var. *matrella*), Bahiagrass (*Paspalum notatum* Flugge), Carpetgrass (*Axonopus affinis* Chase), Centipedegrass (*Eremochloa ophiuroides* Munro Hack,), Kikuyugrass (*Pennisetum clandesinum* Hochst Ex Chiov), Browntop bent (*Agrostis tenuis* also known as *Agrotis capillaris*), Velvet bent (*Agrostis canina*), Perennial ryegrass (*Lolium perenne*), and, St. Augustine-grass (*Stenotaphrum secundatum* Walt. Kuntze). Additional grasses of interest include switchgrass (*Panicum virgatum*).

Preferred plants include corn, soybean, cotton, wheat, rice, potato, oat, barley, sorghum, bean, pea, tobacco, marijuana, tomato, grape, orange, apple, lettuce, beet, peanut, almond, sunflower, alfalfa, hay, rye, millet, rapeseed, canola, chickpea, lupin, *quinoa*, poppy, and lentil.

Having described the invention in detail, it will be apparent that modifications and variations are possible without departing from the scope of the invention defined in the appended claims.

EXAMPLES

The following non-limiting examples are provided to further illustrate the present invention.

Example 1

Identification and Cloning of Monooxygenases, Phenolic Acid Decarboxylases, and Chlorohydrolases from Microbial Libraries To identify enzymes capable of degrading auxin herbicides, the genomes of microbes in microbial libraries containing microorganisms capable of degrading dicamba and/or 2,4-D were screened to identify enzymes capable of degrading chemical substrates containing a benzene or phenoxy ring. Initial strains that were capable of degrading auxinic herbicides, such as dicamba, were grown in minimal media (yeast carbon base) with 1% dicamba or 2,4-D as a sole carbon source for 24-72 hours at 30° C. on a shaker at 225 rpm. Strains that were able to grow using dicamba or 2,4-D as a nutrient source were validated through additional growth on dicamba or 2,4-D by subculturing of the original cultures under the same conditions to ensure that the dicamba or 2,4-D was used as a carbon source. Strains that showed continual growth on dicamba or 2,4-D were grown in Brain Heart Infusion broth overnight at 30° C., and total was DNA isolated using a phenol/chloroform extraction. Total DNA was sent to the University of Washington DNA Core Facility for total genomic DNA characterization, and the final genomes assembled using CLC software (Qiagen Bioinformatics) to achieve complete genome coverage of reads. Control strains that did not grow on dicamba or 2,4-D as a sole carbon source were also treated as above and genomic DNA analyzed. Using subtractive analysis, the genomes of the strains that degraded dicamba and/or 2,4-D were compared to similar strains that did not degrade dicamba and/or 2,4-D, and a list of genes that differed between the two sets of strains was compiled. BLAST (NCBI) was then used to manually search for the activities of these genes, and enzyme classes that act on benzene rings and their related structures were marked for further study. The resultant classes of enzymes that were identified included monooxygenases, diooxygenases, and phenolic acid decarboxylases. Through identification of potential active sites of monooxygenases that may be blocked by chlorine groups, we also identified several chlorohydrolases that may also be able to act on benzene rings with chlorine groups.

The identified enzymes were classified as monooxygenases, phenolic acid decarboxylases, or chlorohydrolases based on their homology to related enzymes in BLAST search results from the NCBI database. The monooxygenases were further classified on the basis of being capable of using salicylic acid, hydroxyphenylacetate, or hydroxybenzoate as a substrate based on the active substrates of related proteins identified as being homologous in BLAST search results.

Figure 3:
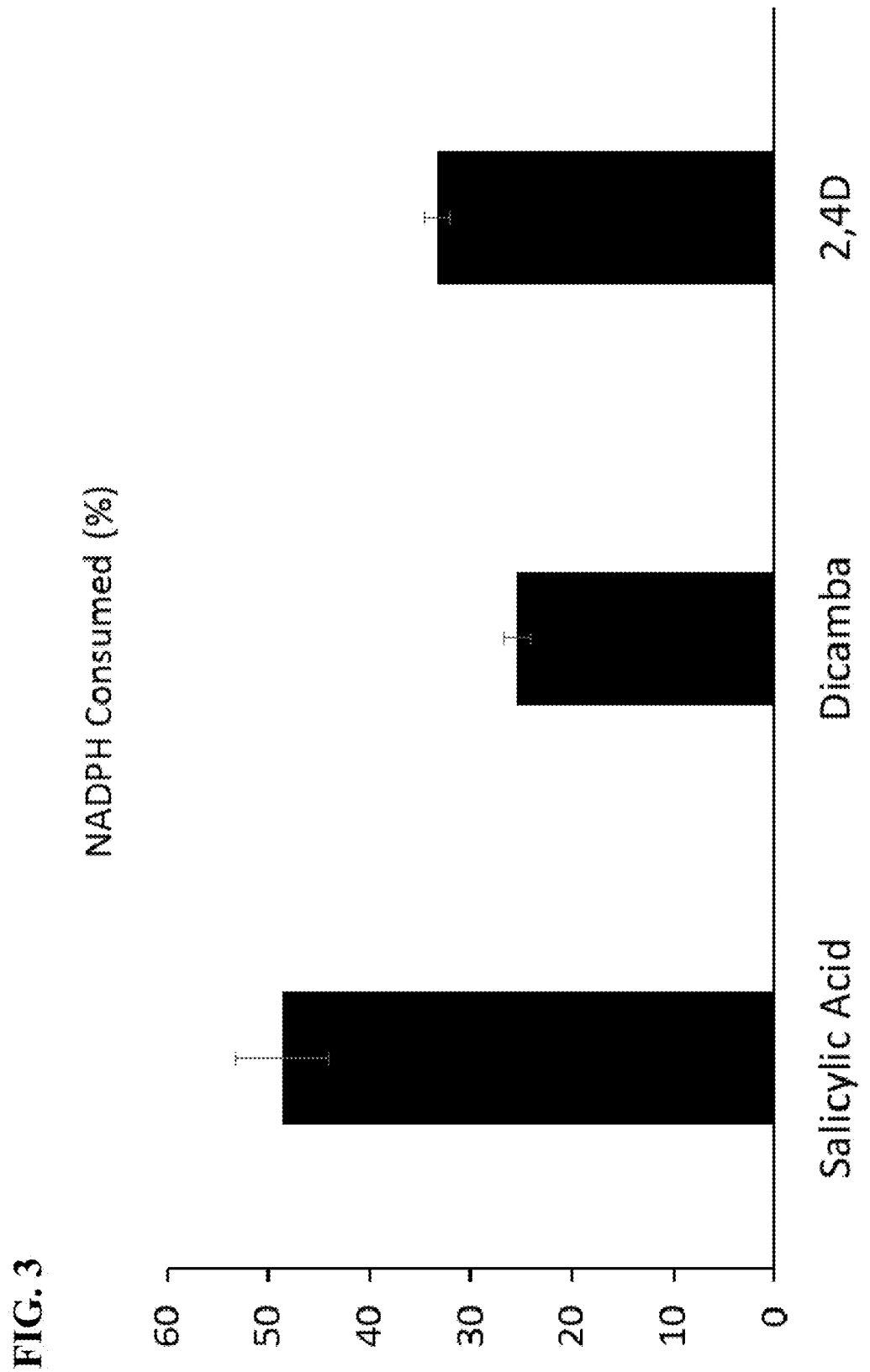
FIG. 3 is a bar graph of illustrative results showing the percent of NADPH consumed in the presence of immobilized salicylate monooxygenase and salicylic acid, dicamba, or 2,4-D.
Figure 4A:
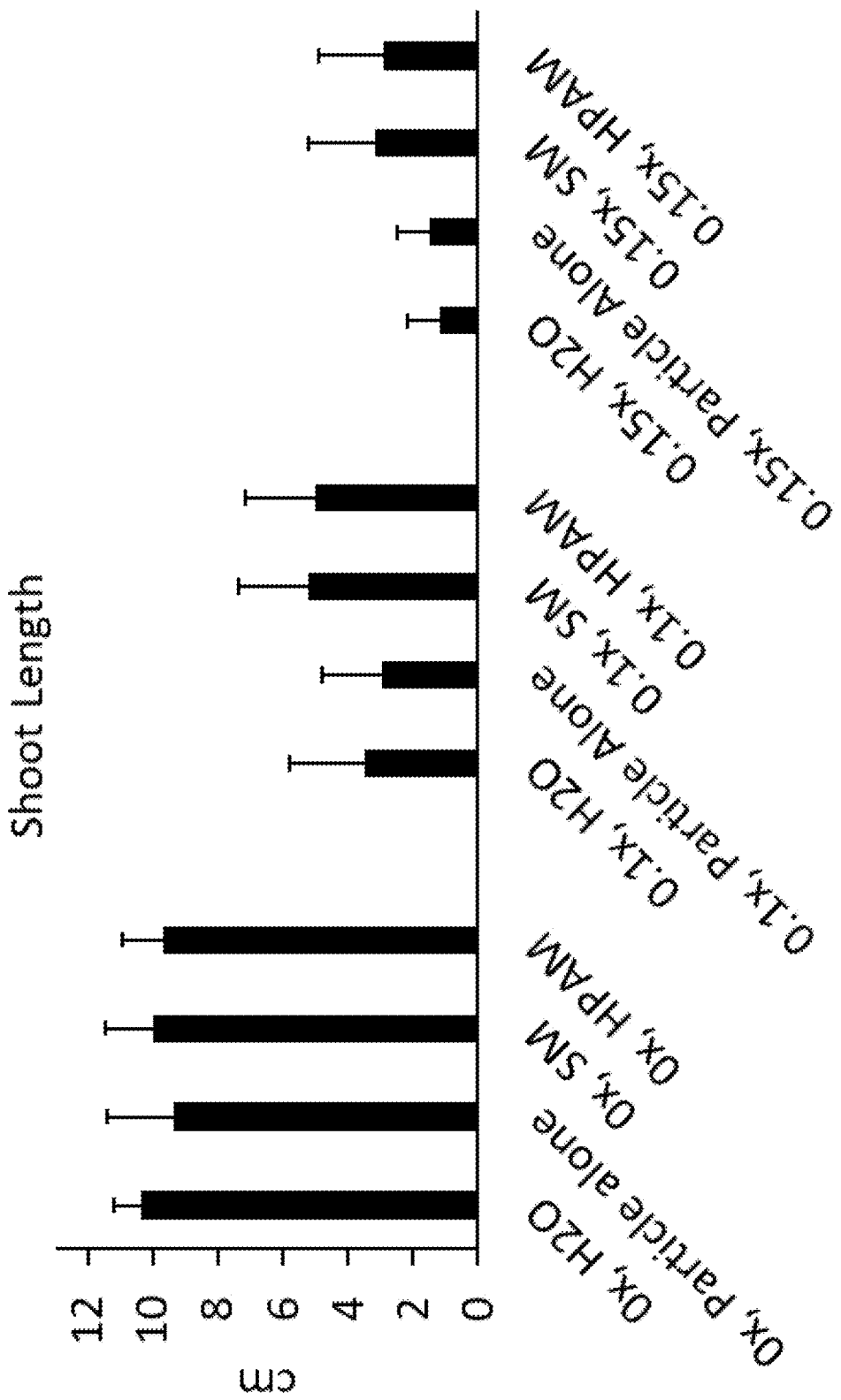
FIG. 4A provides illustrative data showing shoot length for two-week-old lentil plants grown from seeds treated with a water control ($H_2O$), a particle-only control, salicylate monooxygenase (SM) immobilized on particles, or hydroxyphenylacetate monooxygenase (HPAM) immobilized on particles. Seeds were grown in soil in the absence (0×) or presence of dicamba at two different concentrations (0.1× and 0.15×).
Figure 4B:
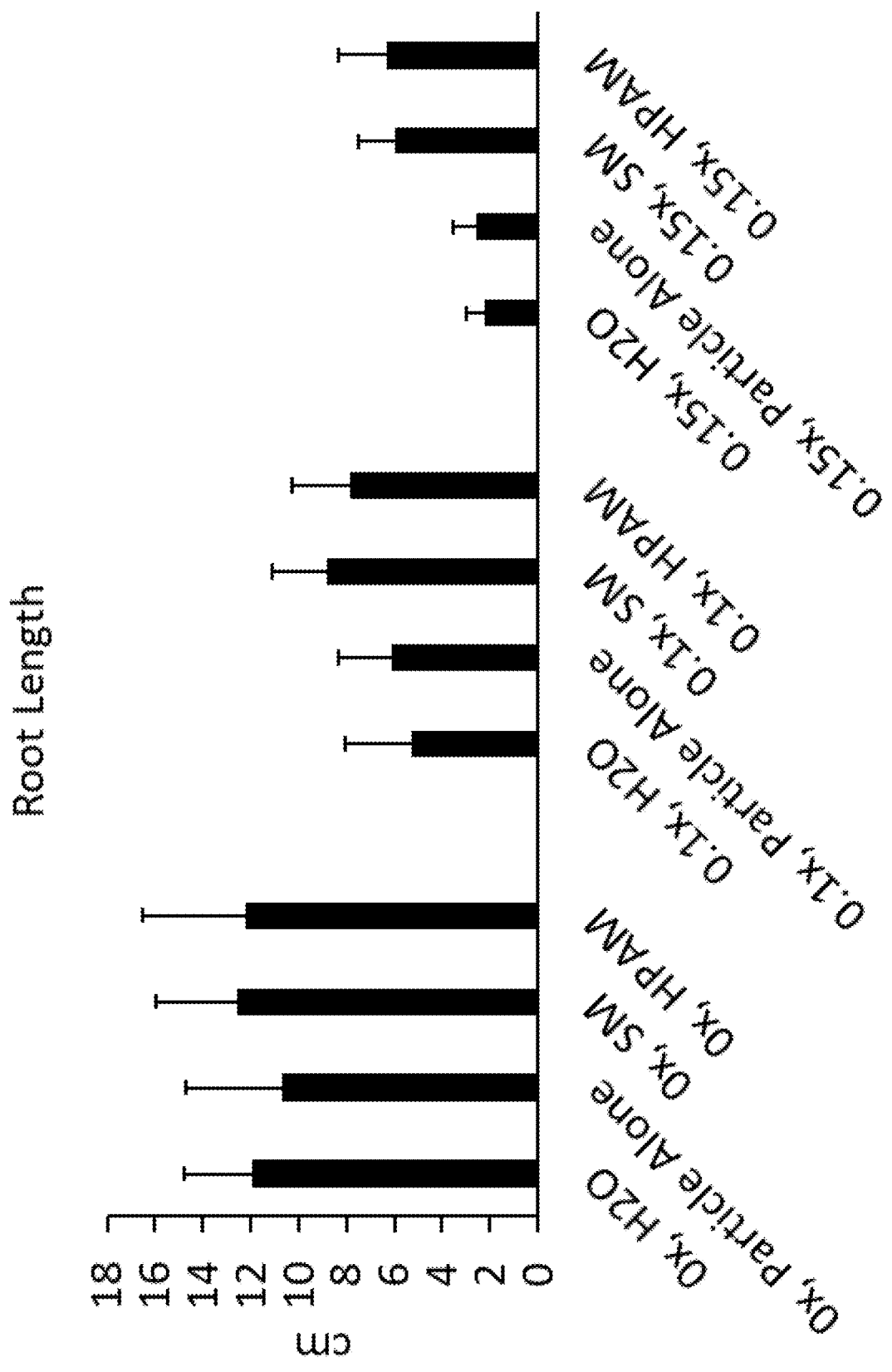
FIG. 4B provides illustrative data showing root length for two-week-old lentil plants grown from seeds treated with a water control ($H_2O$), a particle-only control, salicylate monooxygenase (SM) immobilized on particles, or hydroxyphenylacetate monooxygenase (HPAM) immobilized on particles. Seeds were grown in soil in the absence (0×) or presence of dicamba at two different concentrations (0.1× and 0.15×).
Figure 5:
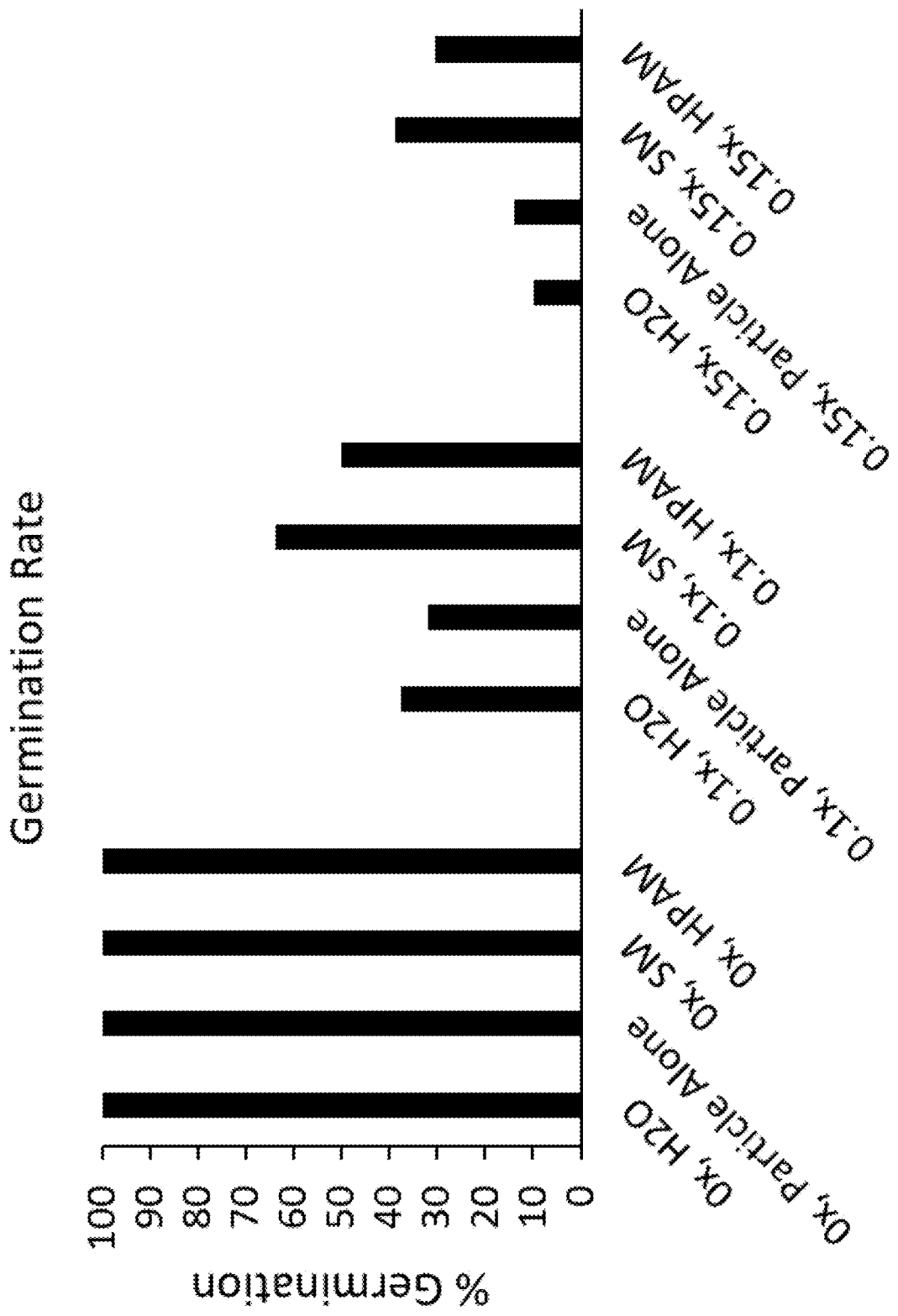
FIG. 5 provides illustrative data showing the germination rate of lentil seeds treated with a water control ($H_2O$), a particle-only control, salicylate monooxygenase (SM) immobilized on particles, or hydroxyphenylacetate monooxygenase (HPAM) immobilized on particles. Seeds were grown in soil in the absence (0×) or presence of dicamba at two different concentrations (0.1× and 0.15×).
Figure 6:
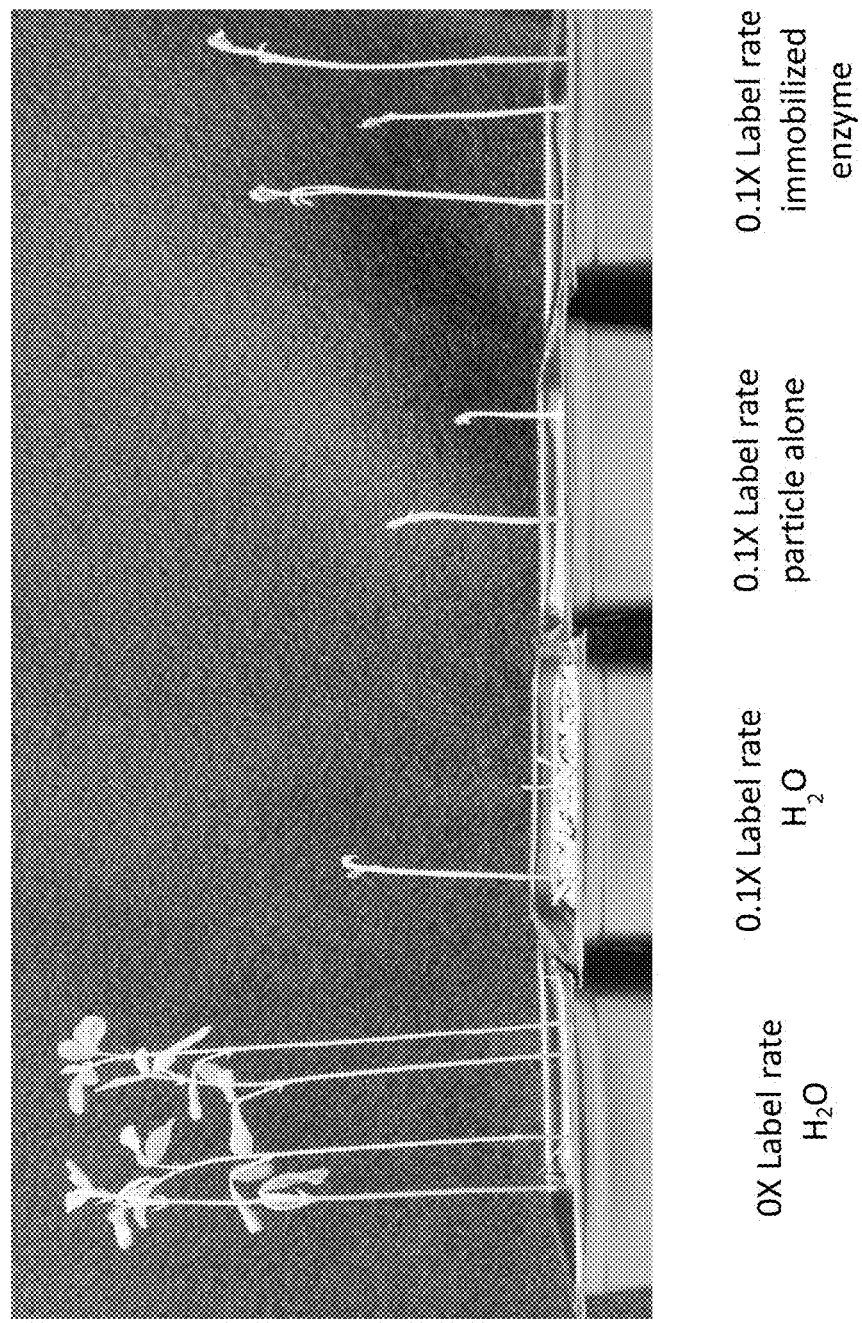
FIG. 6 provides a photograph showing shoot growth in two-week-old lentil plants grown from seeds treated with a water control ($H_2O$), a particle-only control, or salicylate monooxygenase (SM) immobilized on particles. Seeds were grown in soil in the absence (0×) or presence of dicamba (0.1×).
Figure 7:
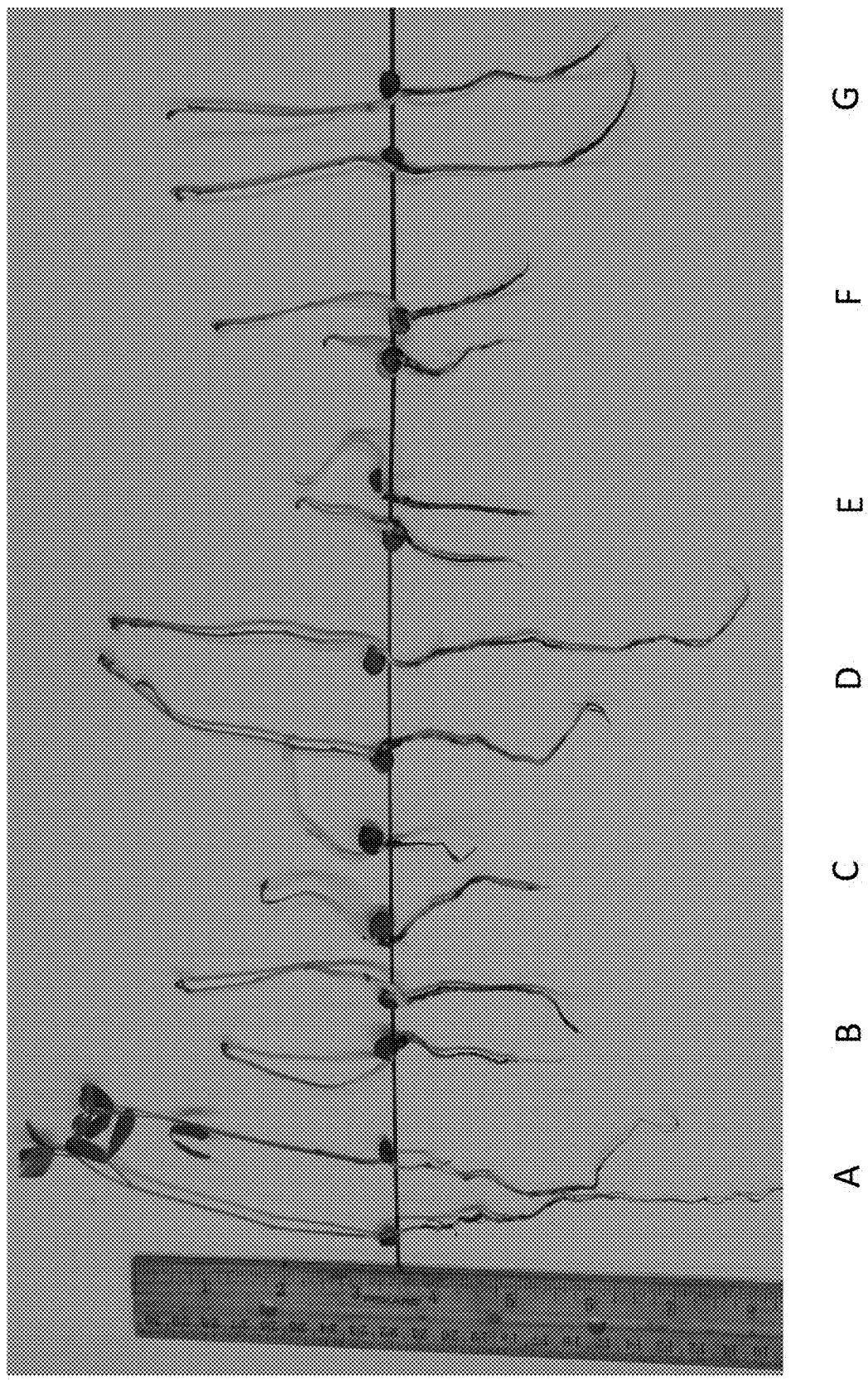
FIG. 7 provides a photograph showing growth (shoot and root lengths) in two-week-old lentil plants grown from seeds treated with water alone, particle alone, or salicylate monooxygenase (SM) immobilized on particles, prior to planting and growth in soil treated with dicamba.
Figure 8:
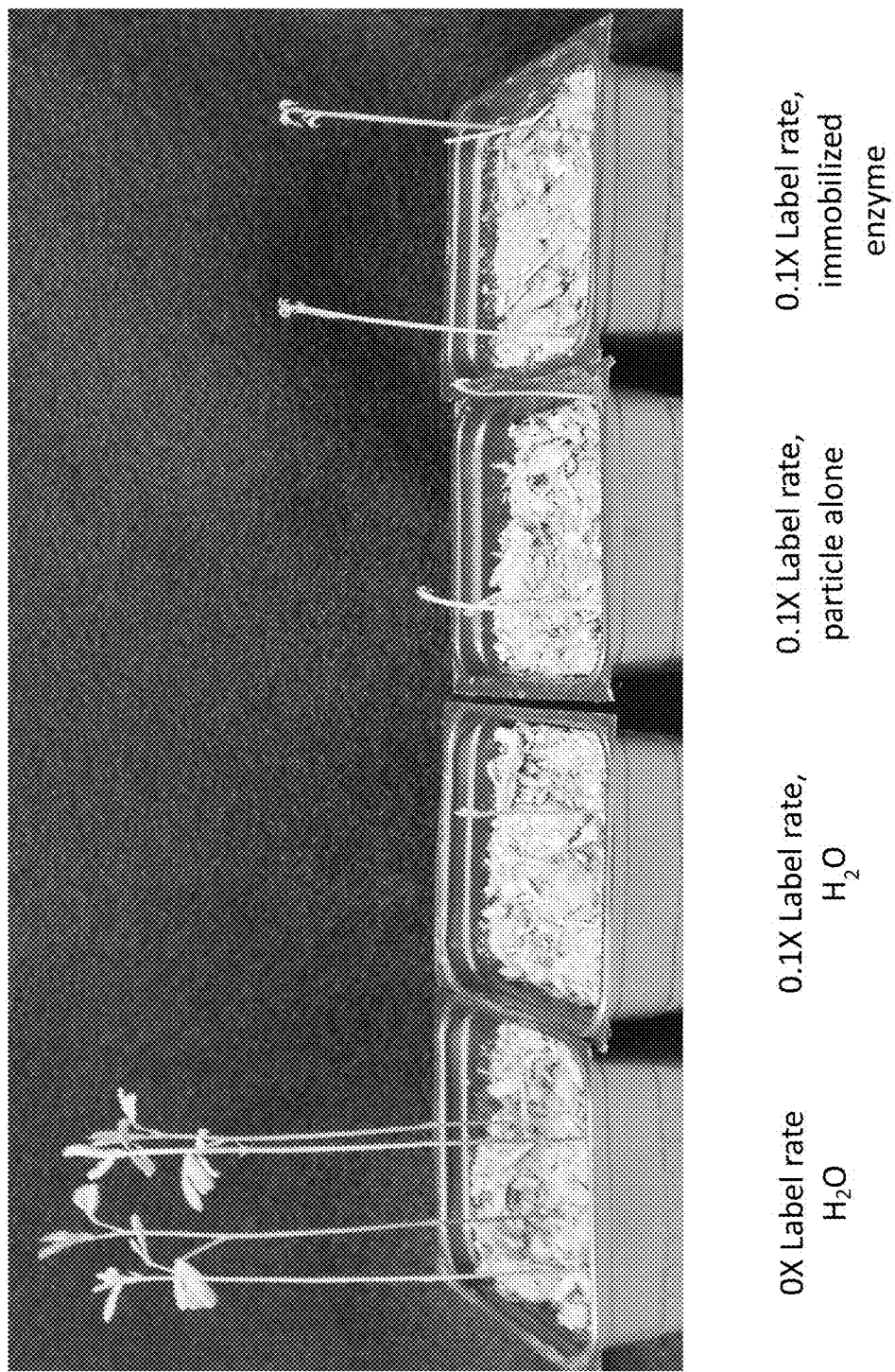
FIG. 8 provides a photograph showing shoot growth in two-week-old lentil plants grown from seeds treated with a water control, particle alone, or hydroxyphenylacetate monooxygenase immobilized on particles. Seeds were grown in soil in the absence (0×) or presence of dicamba (0.1×).

A salicylate monooxygenase (SM), a hydroxyphenylacetate monooxygenase (HPAM), a hydroxybenzoate monooxygenase (HBM), a phenolic acid decarboxylase, and two chlorohydrolases were selected for further analysis. The salicylate monooxygenase, the hydroxyphenylacetate monooxygenase, and the hydroxybenzoate monooxygenase were each isolated from *Bacillus cereus* BGSC 6E1. The salicylate monooxygenase has the nucleotide sequence provided in SEQ ID NO: 1 and the amino acid sequence provided in SEQ ID NO: 21. The hydroxyphenylacetate monooxygenase has the nucleotide sequence provided in SEQ ID NO: 10 and the amino acid sequence provided in SEQ ID NO: 30. The hydroxybenzoate monooxygenase has the nucleic acid sequence provided in SEQ ID NO: 20 and the amino acid sequence provided in SEQ ID NO: 40.

The phenolic acid decarboxylase was isolated from *Bacillus mycoides* B55. The phenolic acid decarboxylase has the nucleic acid sequence provided in SEQ ID NO: 72 and the amino acid sequence provided in SEQ ID NO: 73.

The two chlorohydrolases selected for further analysis were a 6-chloronicotinic acid chlorohydrolase (CAC) isolated from *Bradyrhizobiaceae* strain SG-6C and a chlorothalonil dehalogenase (ChD) isolated from *Pseudomonas* species strain CTN-3. The 6-chloronicotinic acid chlorohydrolase has the nucleic acid sequence provided in SEQ ID NO: 115 and the amino acid sequence provided in SEQ ID NO: 167. The chlorothalonil dehalogenase has the nucleic acid sequence provided in SEQ ID NO: 116 and the amino acid sequence provided in SEQ ID NO: 168.

The genes encoding the salicylate monooxygenase, the hydroxyphenylacetate monooxygenase, the hydroxybenzoate monooxygenase, the phenolic acid decarboxylase, and each of the chlorohydrolases were amplified via PCR using primers designed specifically to the genes in the appropriate *Bacillus, Bradyrhizobiaceae*, and *Pseudomonas* strains. The primer sequences are provided in Table 12 below. In Table 12, "F" refers to the forward primer, and "R" refers to the reverse primer.

TABLE 12

Primer sequences.

| Gene | Primer | SEQ ID NO. |
|---|---|---|
| Salicylate monooxygenase | F | 231 |
| (*Bacillus cereus* BGSC 6E1) | R | 232 |
| Hydroxyphenylacetate monooxygenase | F | 233 |
| (*Bacillus cereus* BGSC 6E1) | R | 234 |
| Hydroxybenzoate monooxygenase | F | 235 |
| (*Bacillus cereus* BGSC 6E1) | R | 236 |
| Phenolic acid decarboxylase | F | 237 |
| (*Bacillus mycoides* B55) | R | 238 |
| 6-chloronicotinic acid chlorohydrolase | F | 239 |
| (Bradyrhizobiaceae strain SG-6C) | R | 240 |
| Chlorothalonil dehalogenase | F | 241 |
| (*Pseudomonas* species CTN-3) | R | 242 |

Each of the two chlorohydrolase genes was also chemically synthesized using GBLOCK technology (Integrated DNA Technologies) and cloned into a plasmid. The plasmids were then electroporated into a host strain for expression.

Example 2

Use of Immobilized Monooxygenases to Detoxify Dicamba and 2,4-D in Solution

Monooxygenases can be used to detoxify herbicides in a solution. Monooxygenases use NADPH as a co-factor when degrading substrates. Consumption of NADPH is proportional to the degradation of the substrate. Accordingly, in the present example, consumption of NADPH was measured to quantify the ability of three different immobilized monooxygenases (salicylate monooxygenase (SM, SEQ ID NO: 21), hydroxyphenylacetate monooxygenase (HPAM, SEQ ID NO: 30), and hydroxybenzoate monooxygenase (HBM, SEQ ID NO: 40)) to degrade dicamba and 2,4-D.

Each enzyme was immobilized on the surface of a particle. Immobilized enzymes were then incubated at 30° C. in an assay buffer containing dicamba (150 μM), 0.5 mM $FeSO_4$, 0.5 mM NADPH, 10 mM $MgCl_2$, and 25 mM HEPES (pH 7). Aliquots were taken from the samples at 30 minute and one hour timepoints, and NADPH consumption was assessed by measuring absorbance at 340 nm using a spectrophotometer. NADPH has an absorbance maximum ($A_{max}$) at 340 nm. As NADPH is converted to NADP+, the peak at 340 nm is lost. Thus, loss of absorbance at 340 nm directly correlates with the amount of NADPH consumed. Results are shown in FIG. 1. For all three of the monooxygenases, NAPDH consumption was increased at the 30 minute timepoint as compared to a no enzyme negative control, and there was an increase in the amount of NADPH consumed at the one hour timepoint as compared to the 30 minute timepoint. These results demonstrate the successful detoxification of dicamba by each of the monooxygenases.

The ability of each of these enzymes to detoxify 2,4-D was evaluated in a similar manner. Immobilized enzymes were incubated at 30° C. in an assay buffer containing 2,4-D (150 M), 0.5 mM $FeSO_4$, 0.5 mM NADPH, 10 mM $MgCl_2$, and 25 mM HEPES (pH 7). Aliquots were taken from the samples at 30 minute and one hour timepoints, and NADPH consumption was assessed by measuring absorbance at 340 nm. Results are shown in FIG. 2. For all three of the monooxygenases, NADPH consumption was increased at both the 30 minute and one hour timepoints as compared to a no enzyme negative control, demonstrating the successful detoxification of 2,4-D by each of the monooxygenases.

An additional experiment was performed to assess the substrate specificity of the salicylate monooxygenase (SM, SEQ ID NO: 21). Consumption of NADPH was measured in the presence of immobilized salicylate monooxygenase and one of the following three substrates: salicylic acid, dicamba, or 2,4-D. Immobilized salicylate monooxygenase was incubated with each of these three substrates at 30° C., using substrate concentrations of 150 µM. The assay buffer also contained 0.5 mM $FeSO_4$, 0.5 mM NADPH, 10 mM $MgCl_2$, and 25 mM HEPES (pH 7). After 60 minutes, absorbance at 340 nm was measured to detect NADPH consumption. Results are shown in FIG. 3. Data are represented as averages+/−SD from three independent reads of each reaction. The data show that salicylate monooxygenase had higher activity towards its natural substrate (salicylic acid), but was also capable of degrading both dicamba and 2,4-D at statistically significant levels as compared to no enzyme negative controls.

Example 3

Application of Immobilized Salicylate Monooxygenase (SM) or Hydroxyphenylacetate Monooxygenase (HPAM) to Seeds Provides Pre-Emergence Protection from Dicamba For each treatment group, eighteen lentil seeds were coated with immobilized salicylate monooxygenase (SM, SEQ ID NO: 21) or hydroxyphenylacetate monooxygenase (HPAM, SEQ ID NO: 30), or with a water-only control ($H_2O$) or a control containing only the particles used for immobilization, without any enzyme ("Particle Alone"). The treated seeds were then planted in soil that contained no dicamba (0×) or dicamba at 0.1× label rate (0.588 mg/L) or 0.15× label rate (0.882 mg/L). These dicamba concentrations were selected because they are representative of the concentrations of dicamba typically found in contaminated soil. Dicamba was diluted into 50 ml of water at the appropriate rate, and added to the soil. 50 ml of water was selected as this is the saturation point of this soil at this scale. Herbicides were allowed to sit in the soil for 24 hours before planting of coated seeds. Germination rate was measured at one week and root and shoot lengths were measured after two weeks.

Results are shown in FIGS. 4A (shoot length), 4B (root length), and 5 (germination rate). As can be seen from FIGS. 4A and 4B, as compared to the water and particle-alone controls, both salicylate monooxygenase and hydroxyphenylacetate monooxygenase had a positive effect on plant growth (both shoot length and root length) in the presence of dicamba at either concentration. The protective effects of the enzymes appear to be relatively stronger in the presence of the higher concentration of the herbicide. This is thought to be due to the higher degree of plant damage at the higher rates of dicamba and the larger separation of the effects at this higher dose on the plants.

The data in FIG. 5 show that both salicylate monooxygenase and hydroxyphenylacetate monooxygenase had a positive effect on germination rates in the presence of dicamba, as compared to the water and particle-alone controls. Data for soil treatments that included dicamba were normalized to control conditions where the soil was treated with water alone. Both enzyme treatments improved germination rate in soils containing either concentration of herbicide.

Further data illustrating the protective effects of salicylate monooxygenase (SM) and hydroxyphenylacetate monooxygenase (HPAM) on lentil plants grown in dicamba-containing soil are provided in FIGS. 6-9. Lentil seeds were treated as described above with water alone, particle alone, or enzyme immobilized on a particle. Seeds were planted in soil that was either free of dicamba or contained dicamba at a concentration of 0.1× label rate (0.588 mg/L) or 0.15× label rate (0.882 mg/L). Growth (shoot and root length) was measured at two weeks.

FIG. 6 provides a photograph of two-week-old lentil plants grown from seeds treated with water alone and grown in soil that did not contain dicamba (far left) as compared to lentil plants grown from seeds treated with water alone and grown in soil containing dicamba at the 0.1× label rate (0.588 mg/L, "0.1× Label rate, $H_2O$"), lentil plants treated with particle alone and grown in soil containing dicamba at the 0.1× label rate ("0.1× Label rate, particle alone"), or lentil plants treated with salicylate monooxygenase immobilized on a particle and grown in soil containing dicamba at the 0.1× label rate ("0.1× Label rate, immobilized enzyme"). As can be seen from FIG. 6, the salicylate monooxygenase had a protective effect. Plants grown from seeds treated with the enzyme had increased shoot lengths in the presence of dicamba as compared to the water only or particle only controls.

FIG. 7 provides a photograph illustrating growth (root and shoot lengths) in two-week-old lentil plants grown subjected to the following treatments: (A) treatment of seeds with water alone, followed by planting and growth in soil that did not contain dicamba; (B) treatment of seeds with water alone, followed by planting and growth in soil containing dicamba at the 0.1× label rate (0.588 mg/L); (C) treatment of seeds with particle alone, followed by planting and growth in soil containing dicamba at the 0.1× label rate; (D) treatment of seeds with salicylate monooxygenase immobilized on particles, followed by planting and growth in soil containing dicamba at the 0.1× label rate; (E) treatment of seeds with water alone, followed by planting and growth in soil containing dicamba at the 0.15× label rate (0.882 mg/L); (F) treatment of seeds with particle alone, followed by planting and growth in soil containing dicamba at the 0.15× label rate; and (G) treatment of seed with salicylate monooxygenase immobilized on particles, followed by planting and growth in soil containing dicamba at the 0.15× label rate. Two representative plants are shown for each treatment group. The results shown in FIG. 7 demonstrate that the salicylate monooxygenase had a protective effect. Both shoots and roots were longer in the plants grown from seeds treated with the enzyme in the presence of either concentration of dicamba (D, G) than in plants grown from seeds treated with water alone or particle alone in the presence of dicamba (B, C, E and F).

FIG. 8 provides a photograph of two-week-old lentil plants grown from seeds treated with water alone and grown in soil that did not contain dicamba (far left) as compared to lentil plants grown from seeds treated with water alone and grown in soil containing dicamba at the 0.1× label rate (0.588 mg/L, "0.1× Label rate, $H_2O$"), lentil plants treated with particle alone and grown in soil containing dicamba at the 0.1× label rate ("0.1× Label rate, particle alone"), or lentil plants treated with hydroxyphenylacetate monooxygenase immobilized on a particle and grown in soil containing dicamba at the 0.1× label rate ("0.1× Label rate, immobilized enzyme"). It can be seen from FIG. 8 that the hydroxyphenylacetate monooxygenase had a protective effect. Plants grown from seeds treated with the enzyme and exposed to dicamba had longer shoot lengths than plants grown from seeds treated with water alone or particle alone and exposed to dicamba.

Figure 9:
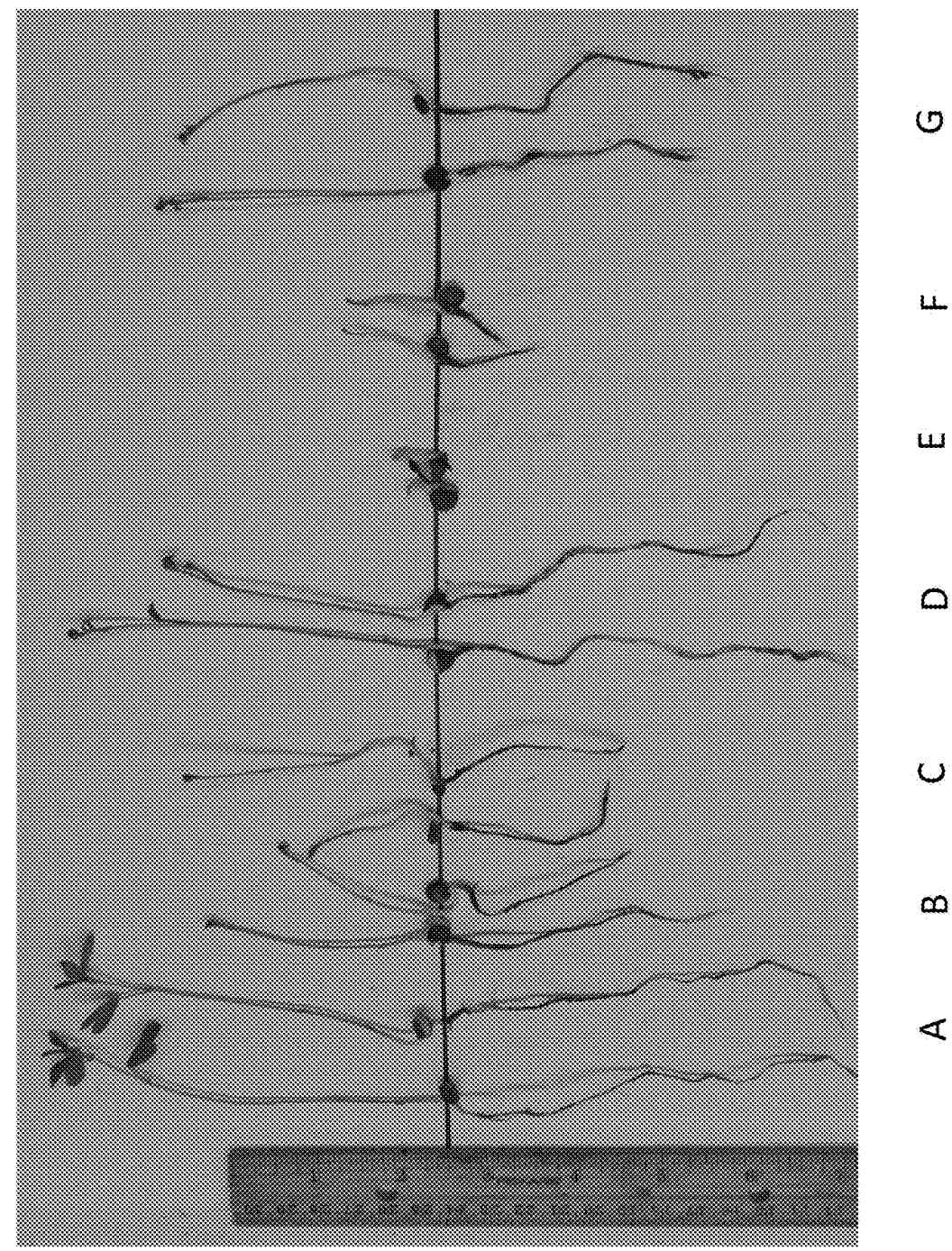
FIG. 9 provides a photograph showing growth (shoot and root lengths) in two-week-old lentil plants grown from seeds treated with water alone, particle alone, or hydroxyphenylacetate monooxygenase (HPAM) immobilized on particles, prior to planting and growth in soil treated with dicamba.

FIG. 9 provides a photograph illustrating growth (root and shoot lengths) in two-week-old lentil plants grown subjected to the following treatments: (A) treatment of seeds with water alone, followed by planting and growth in soil that did not contain dicamba; (B) treatment of seeds with water alone, followed by planting and growth in soil containing dicamba at the 0.1× label rate (0.588 mg/L); (C) treatment of seeds with particle alone, followed by planting and growth in soil containing dicamba at the 0.1× label rate; (D) treatment of seeds with hydroxyphenylacetate monooxygenase immobilized on particles, followed by planting and growth in soil containing dicamba at the 0.1× label rate; (E) treatment of seeds with water alone, followed by planting and growth in soil containing dicamba at the 0.15× label rate (0.882 mg/L); (F) treatment of seeds with particle alone, followed by planting and growth in soil containing dicamba at the 0.15× label rate; and (G) treatment of seed with hydroxyphenylacetate monooxygenase immobilized on particles, followed by planting and growth in soil containing dicamba at the 0.15× label rate. Two representative plants are shown for each treatment group. The results shown in FIG. 9 demonstrate that the hydroxyphenylacetate monooxygenase had a protective effect. Both shoots and roots were longer in the plants grown from seeds treated with the enzyme in the presence of either concentration of dicamba (D, G) than in plants grown from seeds treated with water alone or particle alone in the presence of dicamba (B, C, E and F).

Collectively, the results shown in FIGS. 4-9 demonstrate the ability of monooxygenases to provide pre-emergence protection from dicamba to plants. Thus, monooxygenases can be used to treat seeds that are to be planted in soil contaminated with dicamba.

Example 4

Protection of Plants from Dicamba Injury by Treatment of Dicamba-containing Solutions with Salicylate Monooxygenase (SM) or Hydroxyphenylacetate Monooxygenase (HPAM) Prior to Spray Application to Plants The present Example demonstrates the ability of both salicylate monooxygenase (SM) and hydroxyphenylacetate monooxygenase (HPAM) to detoxify dicamba in a solution, and to thereby protect plants from dicamba injury upon spray application of the solution to the plants.

Salicylate monooxygenase (SM, SEQ ID NO: 21) and hydroxyphenylacetate monooxygenase (HPAM, SEQ ID NO: 30) were immobilized on particles. The immobilized enzymes were then incubated at 30° C. in an assay buffer containing dicamba (208 μM dicamba, 0.5 mM FeSO4, 0.5 mM NADPH, 10 mM MgCl2, 25 mM HEPES, pH7). Aliquots (1 ml) were taken from incubated samples at 0 minutes, 10 minutes, 30 minutes, 1 hour, 5 hours, 24 hours and 30 hours after the introduction of SM and immediately frozen to stop the detoxification reaction. NADPH consumption was quantified by measuring loss of absorbance at 340 nm using a spectrophotometer. Results for SM are shown in panel A of FIG. 10 and results for HPAM are shown in panel A of FIG. 11. Consumption of NADPH is proportional to the degradation of dicamba.

Immediately after taking the absorbance measurements, the 1 ml aliquots were mixed with a nonionic organosilicone surfactant copolymer (0.1% SILWET L77) and 200 μL of the mixture was sprayed onto 2.5-week-old soybean seedlings (six plants per treatment group, on average). The use of the surfactant ensured even distribution of the solutions on the plants. Control plants were sprayed with water+surfactant alone or dicamba+surfactant alone. After one week, the degree of herbicide damage or the degree of protection from dicamba-induced injury (in plants treated with SM) was assessed visually.

Figure 10:
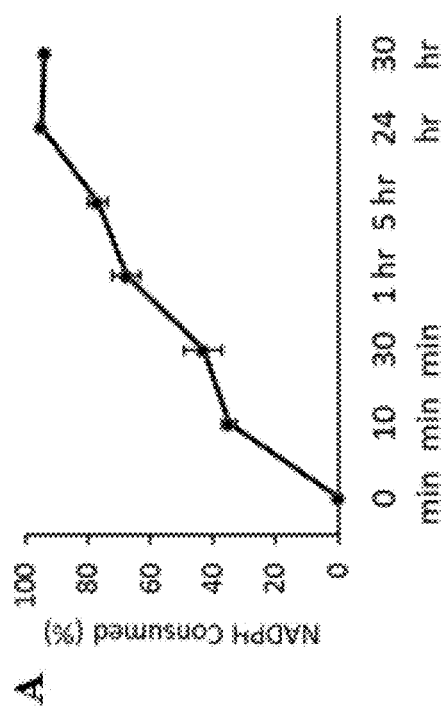
FIG. 10 provides illustrative data showing the percent of NADPH consumed during detoxification of dicamba in solution by immobilized salicylate monooxygenase (SM) at various timepoints (panel A). Panel B of FIG. 10 provides a photograph of 3.5-week-old soybean seedlings one week after spray application of water ($H_2O$), dicamba, or aliquots taken from the solutions analyzed in panel A at the indicated timepoints.
Figure 10:
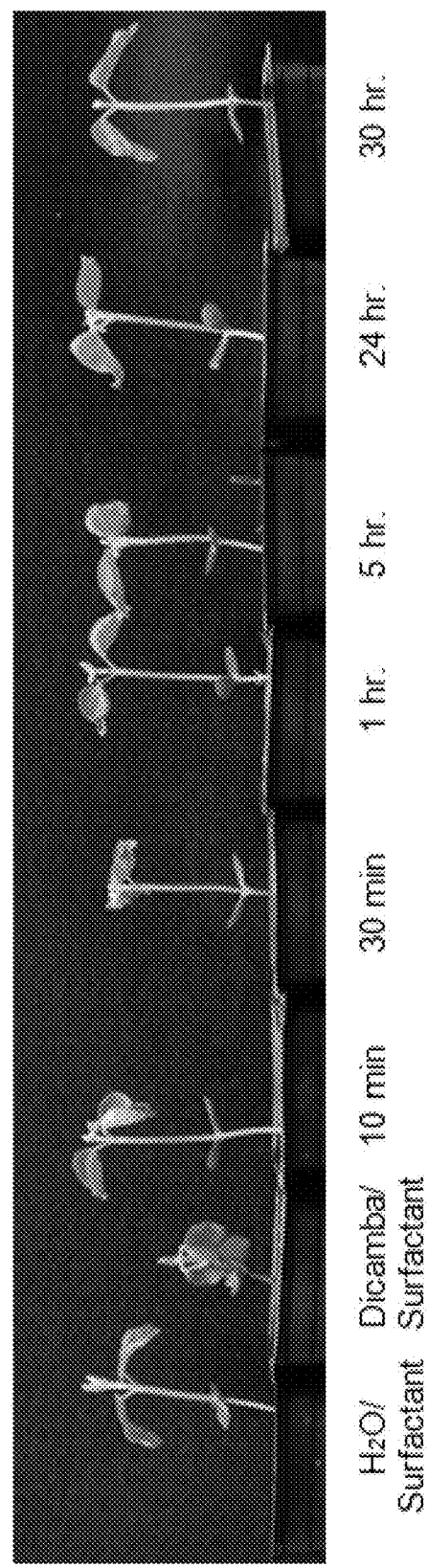

Photographs of the seedlings treated with SM are shown in panel B FIG. 10. The plants treated with dicamba alone (in the absence of enzyme) exhibited significant curling of the leaves and stunted growth. By contrast, all of the soybean plants treated with SM showed similar growth as the water control, even when SM had reacted with dicamba for the shortest duration (10 minutes) prior to treatment (panel B of FIG. 10). The first trifoliate leaves were observed growing on the plants sprayed with the dicamba detoxifying compositions containing SM but not on the plants that treated with dicamba alone. These results indicate that SM can be used to detoxify dicamba and protect soybean plants from dicamba injury. In addition, these results indicate that the end products formed during detoxification of dicamba by SM are non-phytotoxic.

Figure 11:
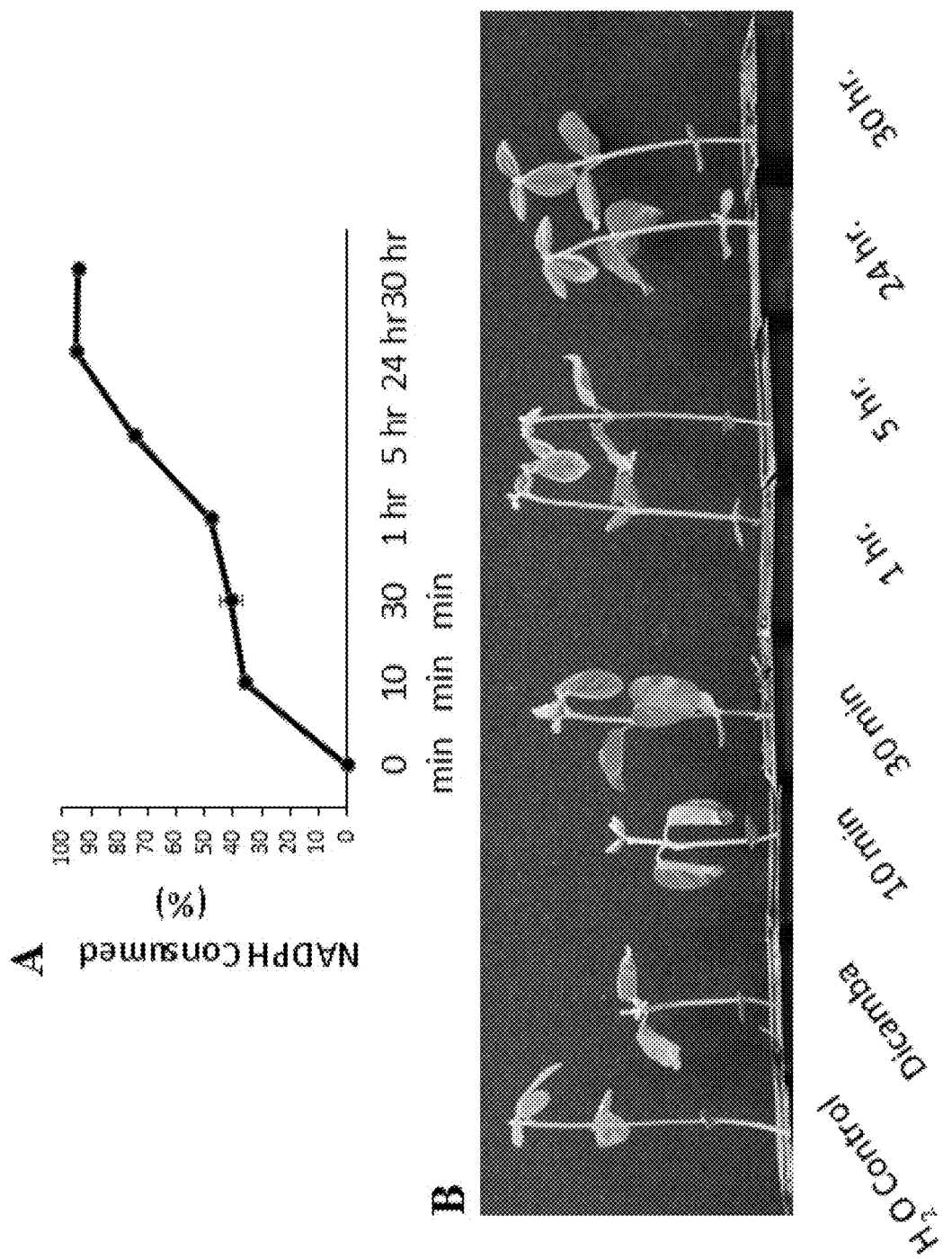
FIG. 11 provides illustrative data showing the percent of NADPH consumed during detoxification of dicamba in solution by immobilized hydroxyphenylacetate monooxygenase (HPAM) at various timepoints (panel A). Panel B of FIG. 11 provides a photograph of 3.5-week-old soybean seedlings one week after spray application of water ($H_2O$), dicamba, or aliquots taken from the solutions analyzed in panel A at the indicated timepoints.

Photographs of the seedlings treated with HPAM are shown in panel B of FIG. 11. Similar protective results were observed with HPAM as with SM, but HPAM took slightly longer to detoxify the dicamba, with the 30 minute incubation timepoint producing results equivalent to those observed in the water-only control. These results indicate that HPAM can be used to detoxify dicamba and protect soybean plants from dicamba injury. In addition, these results indicate that the end products formed during detoxification of dicamba by HPAM are non-phytotoxic.

Example 5

Preparation of Free Enzymes in *E. coli*

Free, non-immobilized enzymes were used in the additional studies of the detoxifying enzymes described in Examples 6-8 below. The genes encoding the salicylate monooxygenase (SM, SEQ ID NO: 1), hydroxyphenylacetate monooxygenase (HPAM, SEQ ID NO: 10), 6-chloronicotinic acid chlorohydrolase (CAC, SEQ ID NO: 115), and chlorothalonil dehalogenase (ChD, SEQ ID NO: 116) were cloned into the pET28a plasmid, transformed into *Escherichia coli* strain B121(DE3) (derived from parental strain K12) and expressed as free enzymes. *E. coli* cultures containing the pET28a plasmids encoding the enzymes were grown in Luria-Bertani (LB) broth to an optical density of $OD_{595}$, equivalent to 0.8. Isopropyl-β-D-thiogalactosidase (IPTG) was then added to a final concentration of 0.1 mM in order to induce protein expression. The "induced" culture was grown for an additional 18 hours at 15° C. on a shaker at 220-300 rpm. The *E. coli* culture expressing the enzymes was pelleted using centrifugation, lysed to completion and re-suspended in a protein extraction buffer. The resulting crude cell lysates were used for some assays. For other assays, the enzymes were His tagged and the crude cell lysates were run through a His purification column and eluted to achieve a highly enriched fraction of each enzyme. The His tag fraction was then diluted to 100 μM.

Example 6

Detoxification of Dicamba and 2,4-D by Chlorothalonil Dehalogenase (ChD) and 6-Chloronicotinic Acid Chlorohydrolase (CAC)

The enzymes chlorothalonil dehalogenase (ChD, SEQ ID NO: 168), isolated from *Pseudomonas* species strain CTN-3, and 6-chloronicotinic acid chlorohydrolase (CAC, SEQ ID NO: 167), isolated from *Bradyrhizobiaceae* strain SG-6C, were assessed for their ability to degrade dicamba and 2,4-D. Commercial formulations of dicamba and 2,4-D were used in these studies. The commercial formulation of dicamba (CLASH, Nufarm) contained 56.8% of the diglycolamine salt of 3,6-dichloro-o-anisic acid. The commercial formulation of 2,4-D (WEEDAR 64, Nufarm) contained 46.8% of the dimethylamine salt of 2,4-dichlorophenoxyacetic acid.

Small scale (1 mL) assays were performed to evaluate ability of ChD and CAC to degrade dicamba or 2,4-D. The assays contained 50 mM HEPES buffer, pH 7.0 and dicamba or 2,4-D at a concentration of 200 mg/L. The assays were run for one hour at 37° C., either in the absence of enzyme or in the presence of the ChD or CAC enzymes, diluted 20× (5 µM) or 40× (2.5 µM) from an initial 100 µM concentration of purified His-tagged enzyme prepared as described above in Example 5. As demonstrated in Example 8 below, an enzyme concentration of 100 µM was found to be effective for protecting plants against dicamba injury when applied exogenously to plants.

Dicamba and 2,4-D have absorbance maxima ($A_{max}$) at approximately 230 nm and 280 nm. The absorbance maxima of the end products produced upon degradation of dicamba and 2,4-D by ChD or CAC are different from those of intact dicamba and 2,4-D, and thus the absorbance spectra can be used to monitor degradation of dicamba and 2,4-D. Dicamba or 2,4-D end product generation is directly proportional to the degradation of dicamba or 2,4-D, respectively.

The end products produced as a result of degradation of dicamba by ChD have an absorbance maximum at approximately 259 nm. The end products produced as a result of degradation of dicamba by CAC also have an absorbance maximum at approximately 259 nm. Thus, the degradation of dicamba by ChD or CAC was measured by monitoring absorbance at 259 nm.

The end products produced as a result of degradation of 2,4-D by ChD or CAC have absorbance maxima at approximately 252 nm. Thus, the degradation of 2,4-D by ChD or CAC was measured by monitoring absorbance at 252 nm.

FIGS. 12A-12D provide absorbance spectra ranging from 220 nm to 340 nm for dicamba or 2,4-D alone, or following incubation with 20× or 40×ChD or CAC.

Figure 12A:
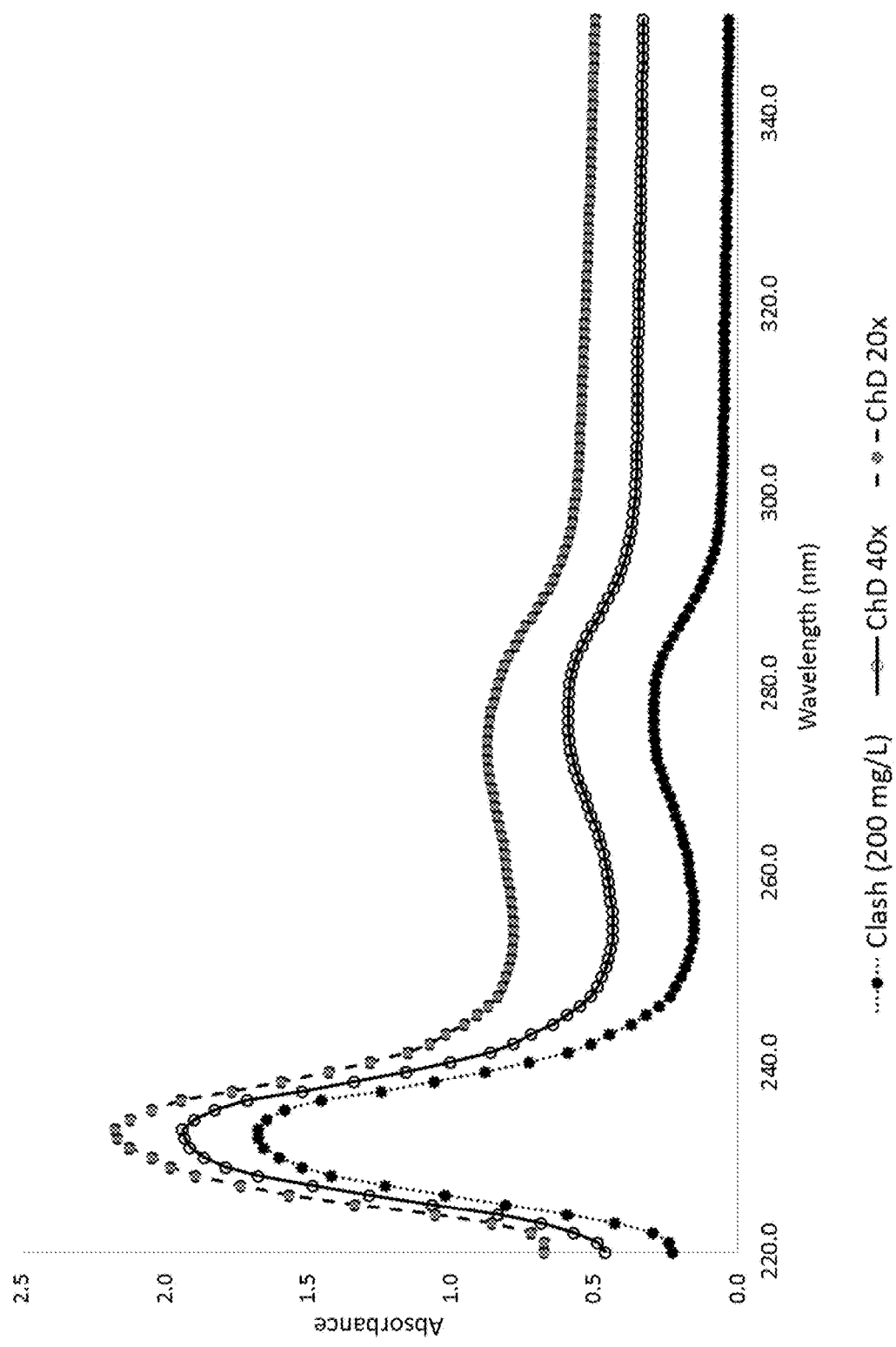
FIGS. 12A-12D provide illustrative absorbance spectra for dicamba ("Clash", FIGS. 12A and 12B) or 2,4-D ("Weedar 64", FIGS. 12C and 12D) alone or following incubation with chlorothalonil dehalogenase (ChD) (FIGS. 12A and 12C) or 6-chloronicotinic acid chlorohydrolase (CAC) (FIGS. 12B and 12D) at two different enzyme concentrations.

FIG. 12A shows absorbance spectra for dicamba alone ("Clash") or in the presence of a 20× or 40× dilution of ChD. A quantitative analysis of these absorbance spectra, and the percent increase in absorbance at 259 nm as a measurement of end product accumulation, is provided in Table 13 below. Percentage increases in end product production are reported for 3 readings per trial.

TABLE 13

Effects of ChD on Absorbance Spectra of Dicamba.

| Treatment | Absorbance Maxima at Wavelength (λ) | | Percent (%) increase in 259 λ (end product formed) compared to dicamba control |
|---|---|---|---|
| | 230 | 259 | |
| Dicamba | 1.59733 | 0.15967 | Control comparison |
| Dicamba + ChD (20X dilution) | 2.04247 | 0.79948 | +501% |
| Dicamba + ChD (40X dilution) | 1.86322 | 0.44951 | +282% |

The absorbance for end products generated by ChD when reacted with dicamba increased 501% when the 20× dilution was used and 282% when the 40× enzyme dilution was used, confirming successful degradation of dicamba by the free enzyme ChD.

Figure 12B:
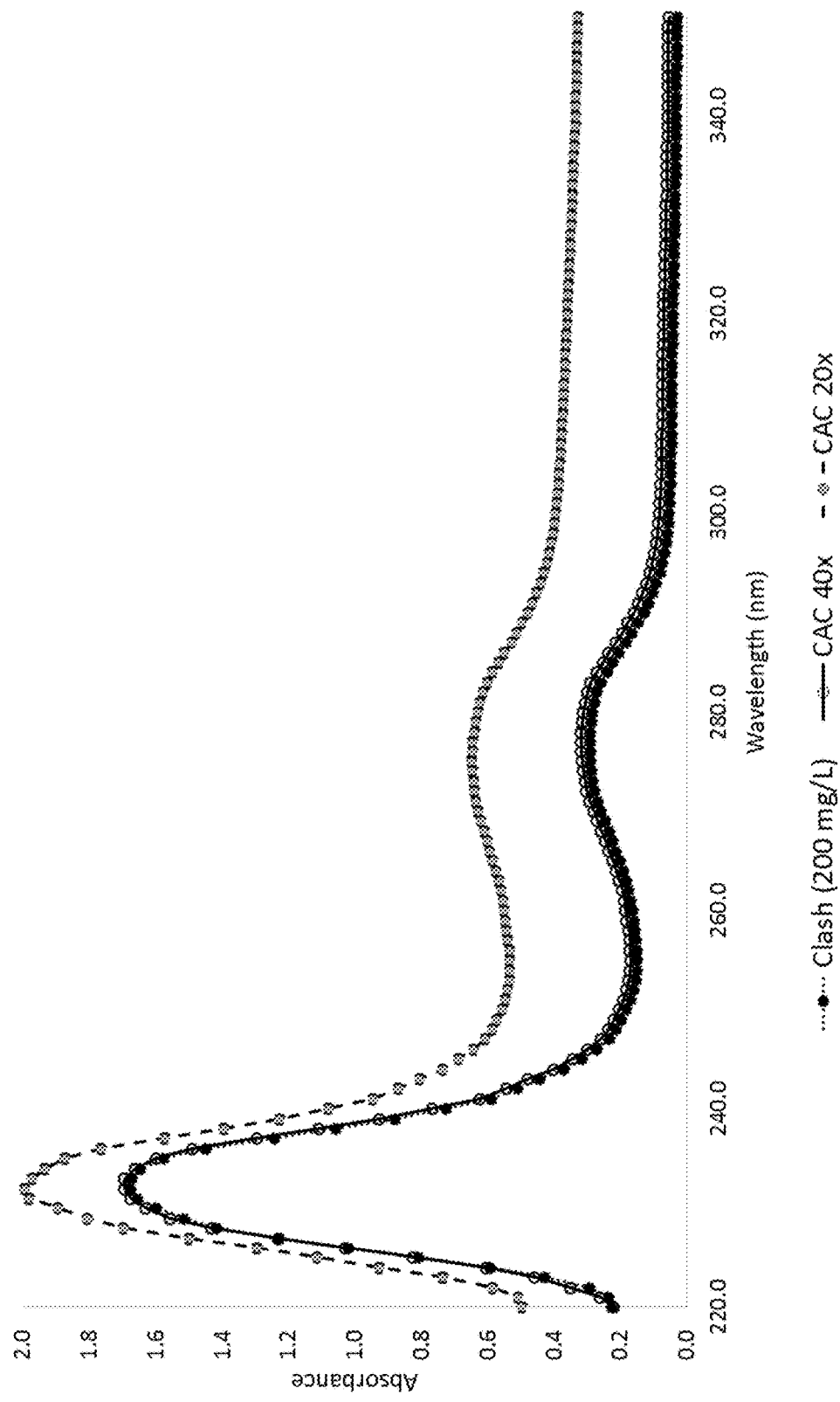

FIG. 12B shows absorbance spectra for dicamba alone ("Clash") or in the presence of a 20× or 40× dilution of CAC. A quantitative analysis of these absorbance spectra, and the percent increase in absorbance at 259 nm as a measurement of end product accumulation, is provided in Table 14 below. Percentage increases in end product production are reported for 3 readings per trial.

TABLE 14

Effects of CAC on Absorbance Spectra of Dicamba.

| Treatment | Absorbance Maxima at Wavelength (λ) | | | Percent (%) increase in 259 λ (end product formed) compared to dicamba control |
|---|---|---|---|---|
| | 230 | 259 | 280 | |
| Dicamba | 1.5967 | 0.15967 | 0.28448 | Control comparison |
| Dicamba + CAC (20X dilution) | 1.8961 | 0.54907 | 0.63196 | +343% |
| Dicamba + CAC (40X dilution) | 1.840 | 0.18071 | 0.31347 | +113% |

The absorbance for end products generated by CAC when reacted with dicamba increased 344% when the 20× dilution was used and 113% when the 40× enzyme dilution was used, confirming successful degradation of dicamba by the free enzyme CAC.

Figure 12C:
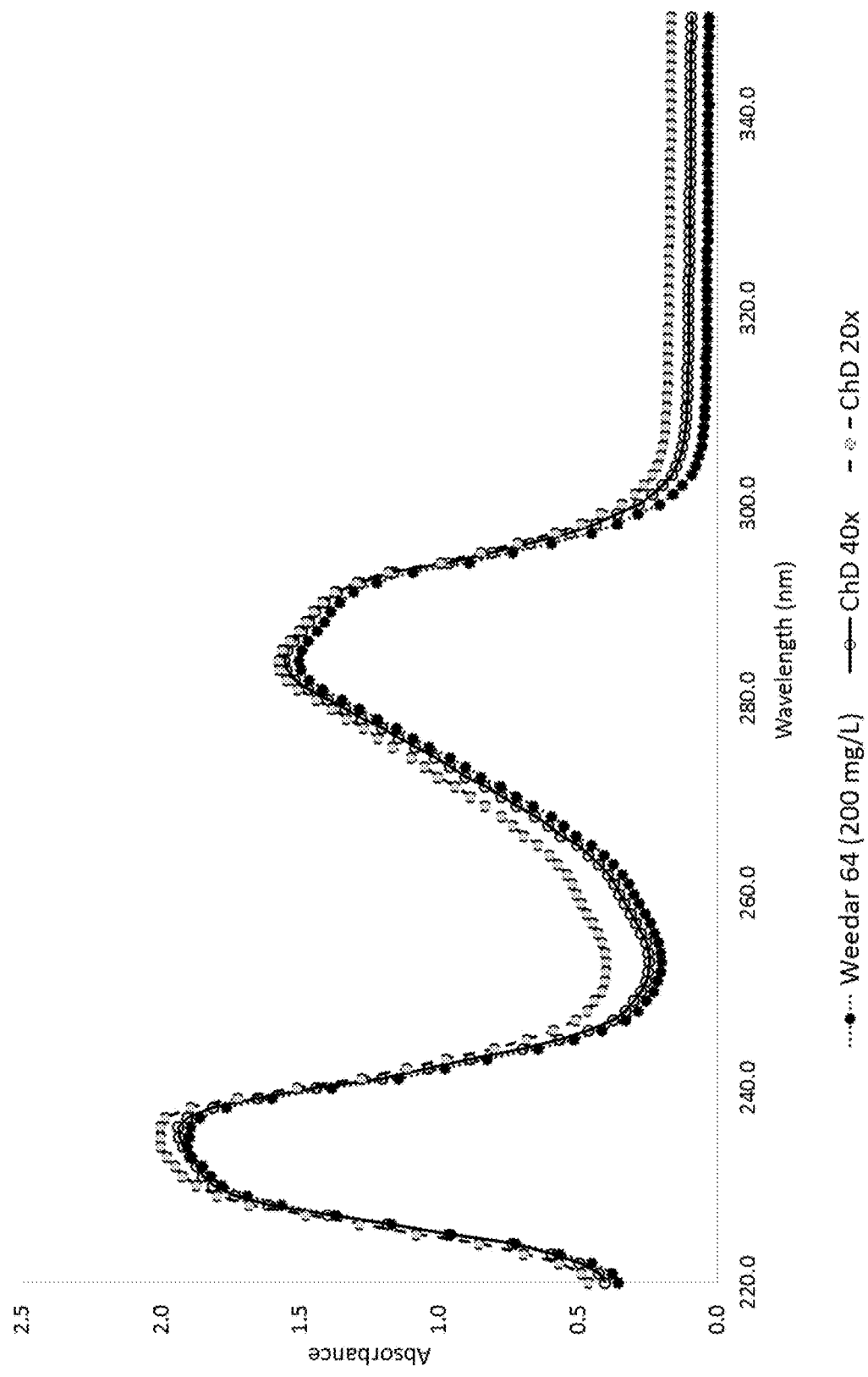

FIG. 12C shows absorbance spectra for 2,4-D alone ("Weedar 64") or in the presence of a 20× or 40× dilution of ChD. A quantitative analysis of these absorbance spectra, and the percent increase in absorbance at 252 nm as a measurement of end product accumulation, is provided in Table 15 below. Percentage increases in end product production are reported for 3 readings per trial.

TABLE 15

Effects of ChD on Absorbance Spectra of 2,4-D.

| Treatment | Absorbance Maxima at Wavelength (λ) | | | Percent (%) increase in 252 λ, (end product formed) compared to 2,4-D control |
|---|---|---|---|---|
| | 230 | 252 | 280 | |
| 2,4-D | 1.77821 | 0.20244 | 1.48971 | Control comparison |

TABLE 15-continued

Effects of ChD on Absorbance Spectra of 2,4-D.

| Treatment | Absorbance Maxima at Wavelength (λ) | | | Percent (%) increase in 252 λ, (end product formed) compared to 2,4-D control |
|---|---|---|---|---|
| | 230 | 252 | 280 | |
| 2,4-D + ChD (20X dilution) | 1.87344 | 0.39688 | 1.56024 | +196% |
| 2,4-D ChD (40X dilution) | 1.81188 | 0.2463 | 1.54226 | +122% |

The absorbance for end products generated by ChD when reacted with 2,4-D increased 196% when the 20× dilution was used and 122% when the 40× enzyme dilution was used, confirming successful degradation of 2,4-D by the free enzyme ChD.

Figure 12D:
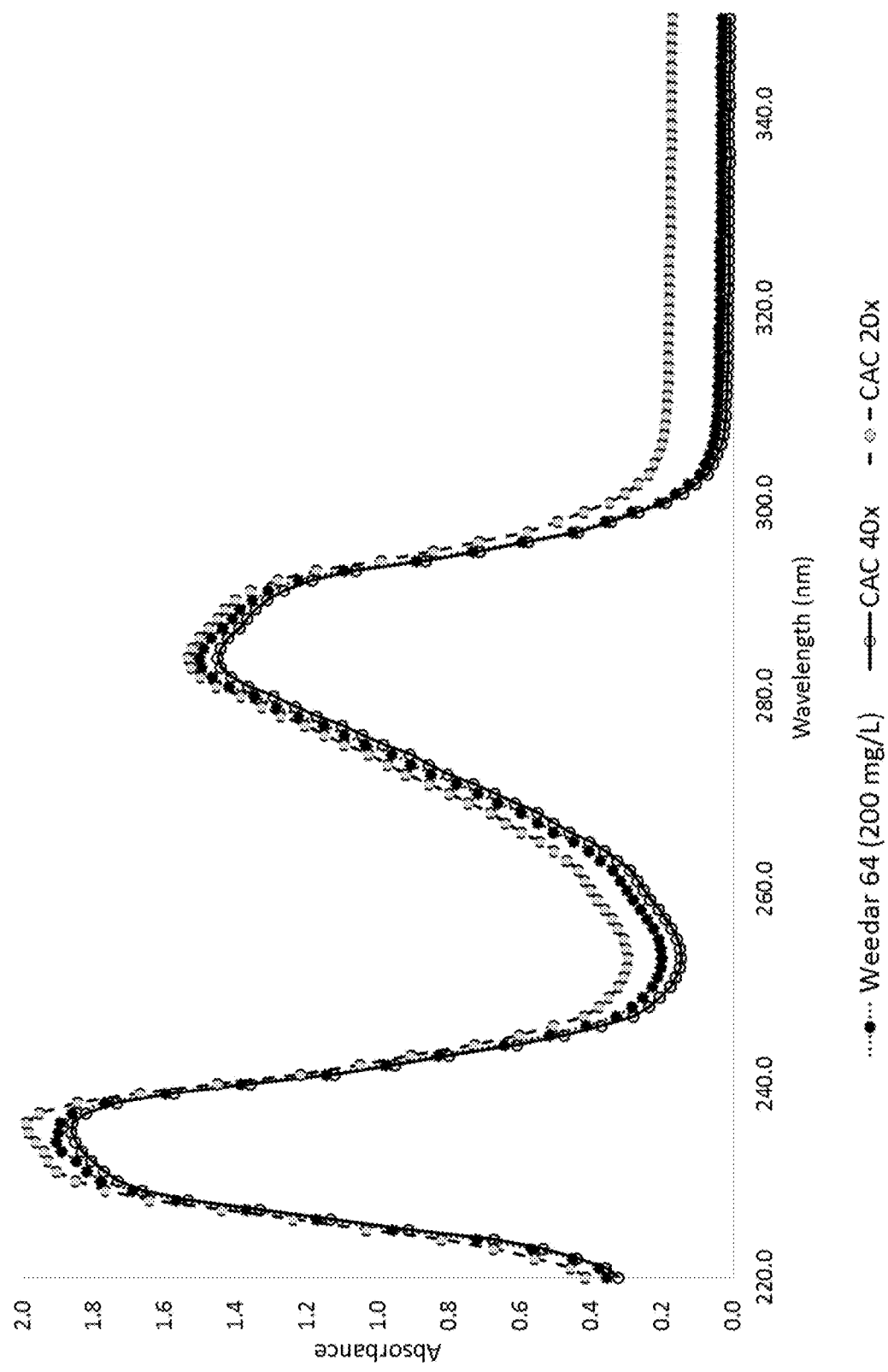

FIG. 12D shows absorbance spectra for 2,4-D alone ("Weedar 64") or in the presence of a 20× or 40× dilution of CAC. A quantitative analysis of these absorbance spectra, and the percent increase in absorbance at 252 nm as a measurement of end product accumulation, is provided in Table 16 below. Percentage increases in end product production are reported for 3 readings per trial.

TABLE 16

Effects of CAC on Absorbance Spectra of 2,4-D.

| Treatment | Absorbance Maxima at Wavelength (λ) | | | Percent (%) increase in 252 λ, (end product formed) compared to 2,4-D control |
|---|---|---|---|---|
| | 230 | 252 | 280 | |
| 2,4-D | 1.77821 | 0.20244 | 1.34551 | Control comparison |
| 2,4-D + CAC (20X dilution) | 1.84946 | 0.29875 | 1.3857 | +148% |
| 2,4-D + CAC (40X dilution) | 1.73281 | 0.15004 | 1.29253 | −26% |

The absorbance for end products generated by CAC when reacted with 2,4-D increased 148% when the 20× dilution was used, demonstrating successful degradation of 2,4-D by the free enzyme CAC.

Example 7

Detoxification of MCPA-4-amine and Mecoprop by Chlorothalonil Dehalogenase (ChD) and 6-Chloronicotinic Acid Chlorohydrolase (CAC)

The enzymes chlorothalonil dehalogenase (ChD, SEQ ID NO: 168), isolated from *Pseudomonas* species strain CTN-3, and 6-chloronicotinic acid chlorohydrolase (CAC, SEQ ID NO: 167), isolated from *Bradyrhizobiaceae* strain SG-6C, were also assessed for their ability to degrade MCPA-4 amine and mecoprop. Small scale (1 mL) assays were performed to evaluate the ability of ChD and CAC to degrade MCPA-4 amine or mecoprop. The assays contained 50 mM HEPES buffer, pH 7 and MCPA-4 amine or mecoprop at a concentration of 200 mg/L. The assays were run for one hour at 37° C., either in the absence of enzyme or in the presence of the ChD or CAC enzymes, diluted 20× (5 μM) or 40× (2.5 μM) from an initial 100 μM concentration of purified His-tagged enzyme prepared as described above in Example 5. As demonstrated in Example 8 below, an enzyme concentration of 100 μM was found to be effective for protecting plants against dicamba injury when applied exogenously to plants.

MCPA-4 amine and mecoprop have absorbance maxima ($A_{max}$) at approximately 230 and 280 nm. The absorbance maxima of the end products produced upon degradation of MCPA-4 amine and mecoprop by ChD or CAC are at approximately 252 nm. Thus, the absorbance spectra can be used to monitor degradation of MCPA-4 amine and mecoprop by ChD or CAC. MCPA-4 amine or mecoprop end product generation is directly proportional to the degradation MCPA-4 amine or mecoprop, respectively.

FIGS. 13A-13D provide absorbance spectra ranging from 220 nm to 340 nm for MCPA-4 amine or mecoprop alone, or following incubation with 20× or 40×ChD or CAC.

Figure 13A:
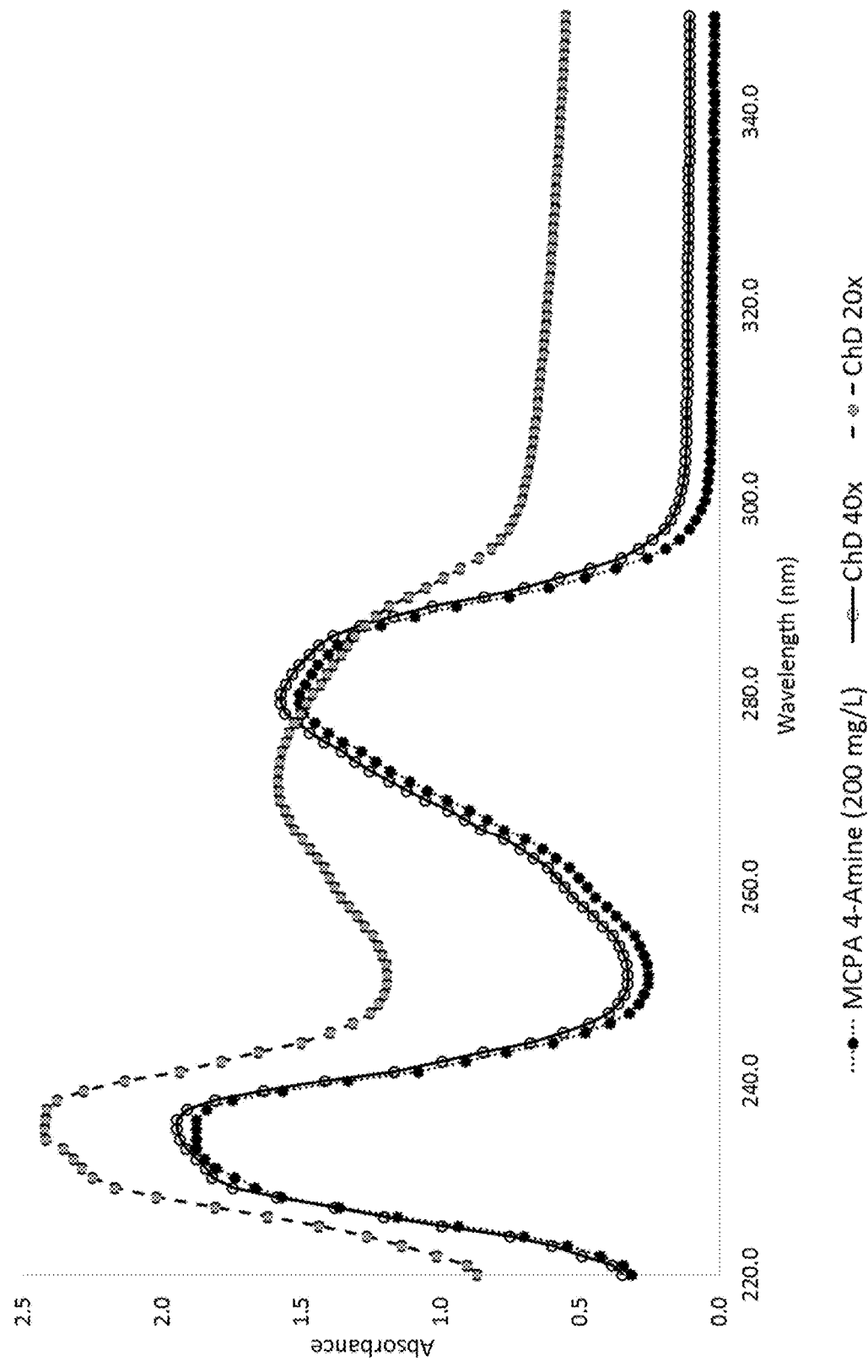
FIGS. 13A-13D provide illustrative absorbance spectra for MCPA-4 amine (FIGS. 13A and 13B) or mecoprop (FIGS. 13C and 13D) alone or following incubation with chlorothalonil dehalogenase (ChD) (FIGS. 13A and 13C) or 6-chloronicotinic acid chlorohydrolase (CAC) (FIGS. 13B and 13D) at two different enzyme concentrations.

FIG. 13A shows absorbance spectra for MCPA-4 amine alone or in the presence of a 20× or 40× dilution of ChD. A quantitative analysis of these absorbance spectra, and the percent increase in absorbance at 252 nm as a measurement of end product accumulation, is provided in Table 17 below. Percentage increases in end product production are reported for 3 readings per trial.

TABLE 17

Effects of ChD on Absorbance Spectra of MCPA-4 amine.

| Treatment | Absorbance Maxima at Wavelength (λ) | | | Percent (%) increase in 252 λ (end product formed) compared to MCPA-4-Amine control |
|---|---|---|---|---|
| | 230 | 252 | 280 | |
| MCPA-4-Amine | 1.73869 | 0.25727 | 1.50609 | Control comparison |
| MCPA-4-Amine + ChD (20X dilution) | 2.25108 | 1.19553 | 1.4573 | +464% |
| MCPA-4-Amine + ChD (40X dilution) | 1.82281 | 0.33168 | 1.57333 | +128.9% |

The absorbance for end products generated by ChD when reacted with MCPA-4 amine increased 464% when the 20× dilution was used and 128.9% when the 40× enzyme dilution was used, confirming successful degradation of MCPA-4amine by the free enzyme ChD.

Figure 13B:
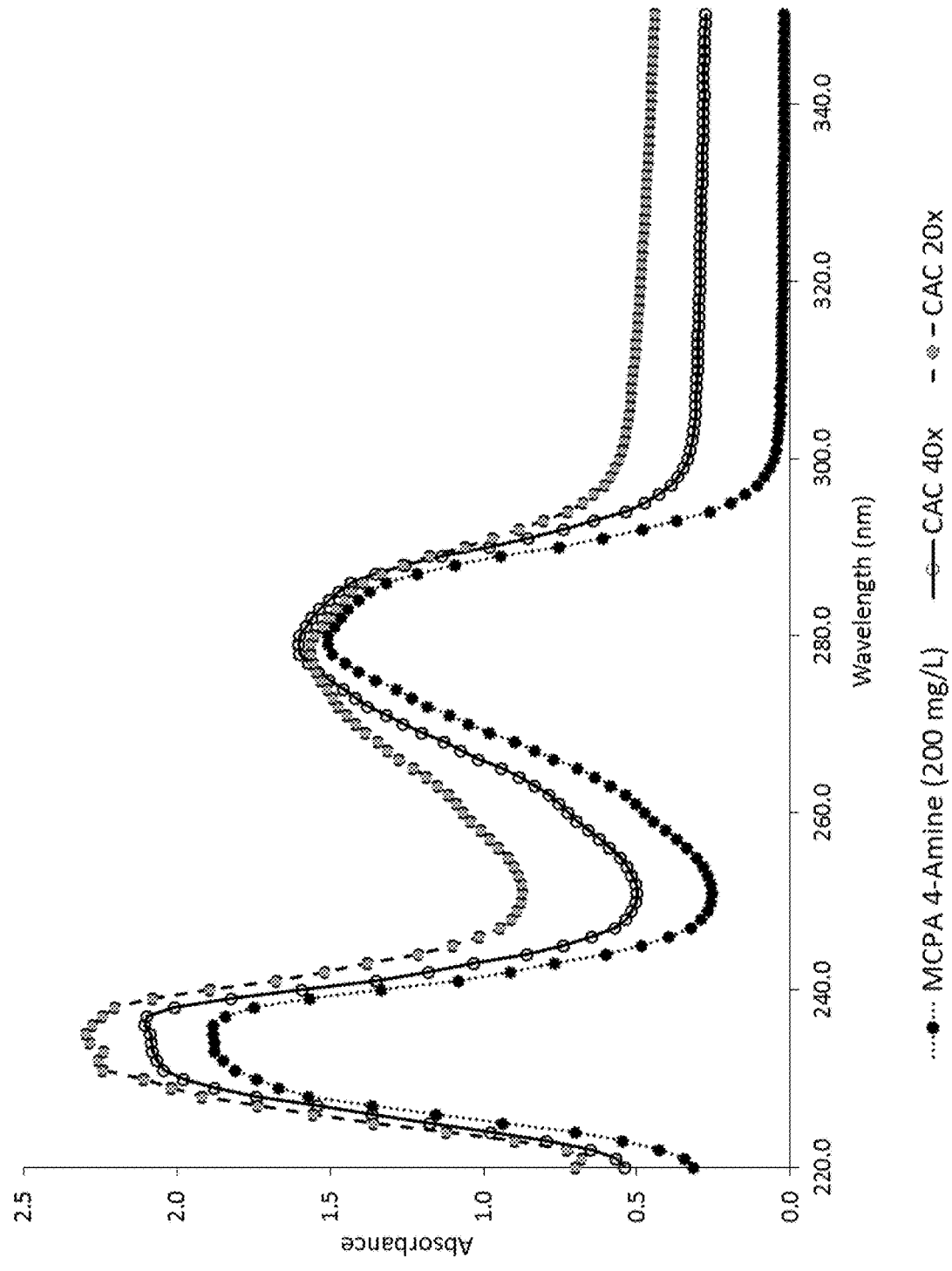

FIG. 13B provides absorbance spectra for MCPA-4 amine alone or in the presence of a 20× or 40× dilution of CAC. A quantitative analysis of these absorbance spectra, and the percent increase in absorbance at 252 nm as a measurement of end product accumulation, is provided in Table 18 below. Percentage increases in end product production are reported for 3 readings per trial.

TABLE 18

Effects of CAC on Absorbance Spectra of MCPA-4 amine.

| Treatment | Absorbance Maxima at Wavelength (λ) | | | Percent (%) increase in 252 λ (end-product formed) compared to MCPA-4-Amine control |
|---|---|---|---|---|
| | 230 | 252 | 280 | |
| MCPA-4-Amine | 1.73869 | 0.25727 | 1.50609 | Control comparison |
| MCPA-4-Amine + CAC (20X dilution) | 2.10849 | 0.87567 | 1.55039 | +340% |

TABLE 18-continued

Effects of CAC on Absorbance Spectra of MCPA-4 amine.

| Treatment | Absorbance Maxima at Wavelength (λ) | | | Percent (%) increase in 252 λ (end-product formed) compared to MCPA-4-Amine control |
|---|---|---|---|---|
| | 230 | 252 | 280 | |
| MCPA-4-Amine + CAC (40X dilution) | 1.97643 | 0.5026 | 1.59993 | +195% |

The absorbance for end-products generated by CAC when reacted with MCPA-4 amine increased 340% when the 20× dilution was used and 195% when the 40× enzyme dilution was used, confirming successful degradation of MCPA-4 amine by the free enzyme CAC.

Figure 13C:
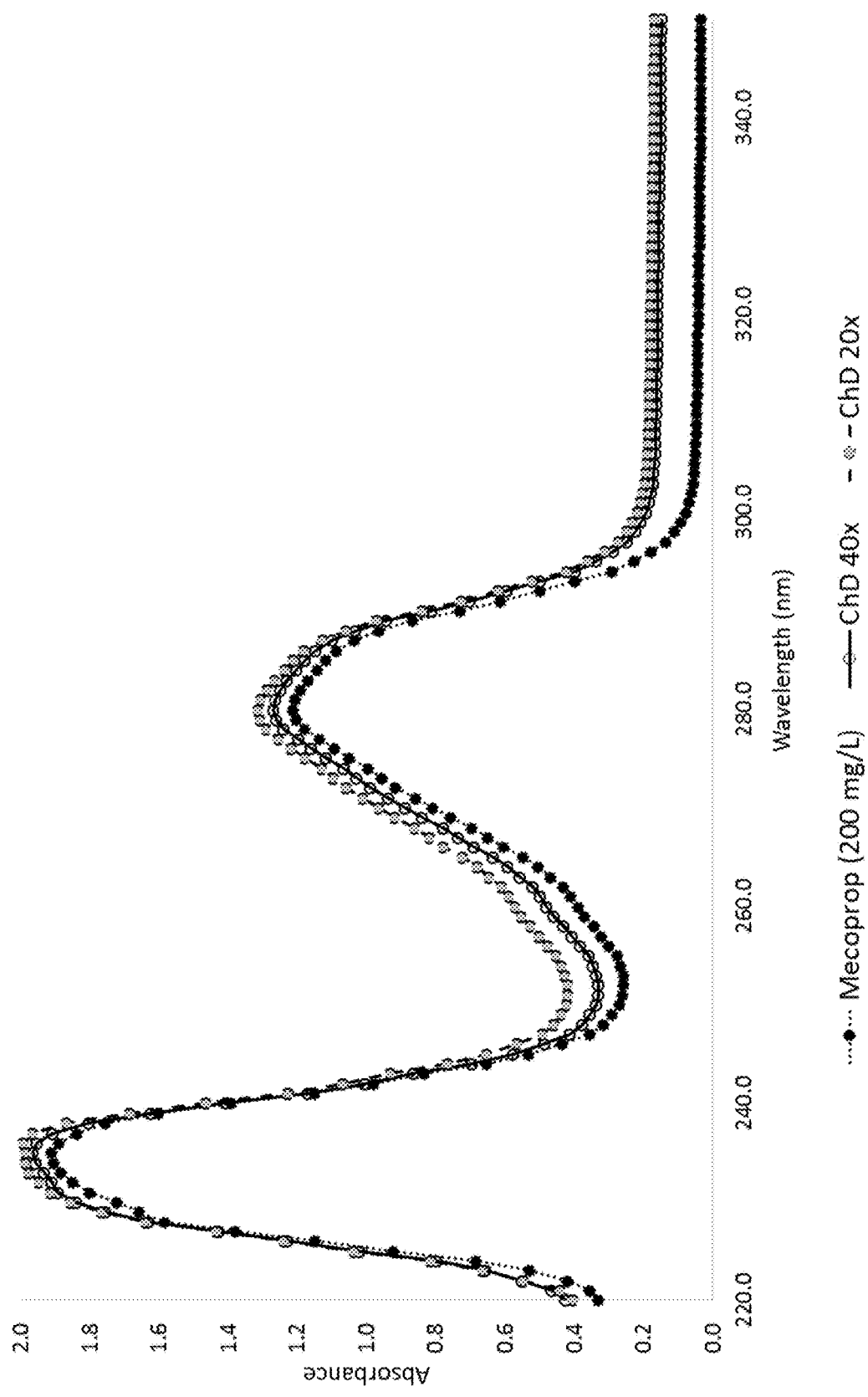

FIG. 13C provides absorbance spectra for mecoprop alone or in the presence or a 20× or 40× dilution of ChD. A quantitative analysis of these absorbance spectra, and the percent increase in absorbance at 252 nm as a measurement of end product accumulation, is provided in Table 19 below. Percentage increases in end product production are reported for 3 readings per trial.

TABLE 19

Effects of ChD on absorbance spectra of mecoprop.

| Treatment | Absorbance Maxima at Wavelength (λ) | | | Percent (%) increase in 252 λ (end-product formed) compared to Mecoprop control |
|---|---|---|---|---|
| | 230 | 252 | 280 | |
| Mecoprop | 1.72272 | 0.25619 | 1.21389 | Control comparison |
| Mecoprop + ChD (20X dilution) | 1.85606 | 0.41984 | 1.31639 | +164% |
| Mecoprop + ChD (40X dilution) | 1.8419 | 0.32969 | 1.27003 | +129% |

The absorbance for end products generated by ChD when reacted with mecoprop increased 164% when the 20× enzyme dilution was used and 129% when the 40× enzyme dilution was used, confirming successful degradation of mecoprop by the free enzyme ChD.

Figure 13D:
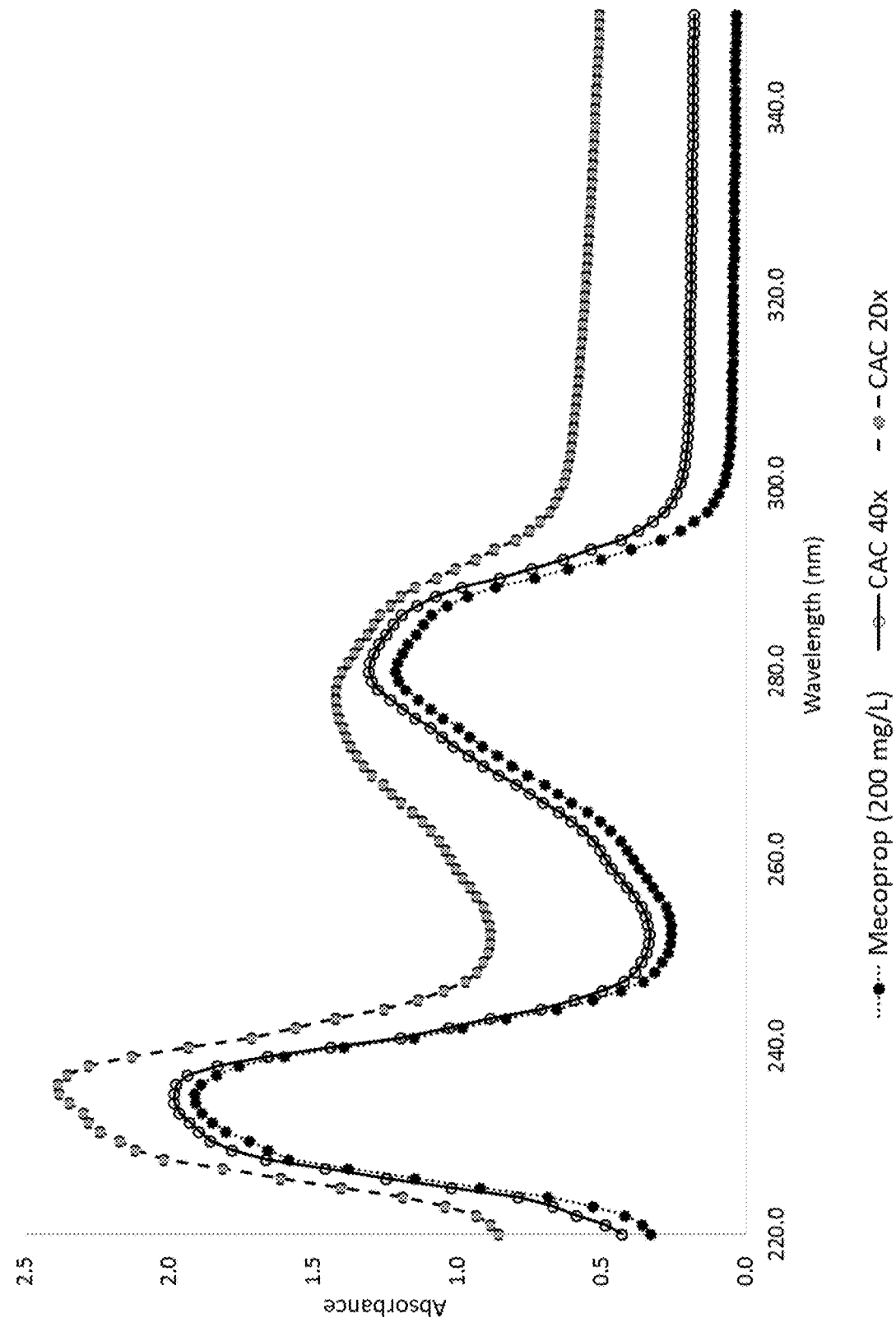

FIG. 13D provides absorbance spectra for mecoprop alone or in the presence or a 20× or 40× dilution of CAC. A quantitative analysis of these absorbance spectra, and the percent increase in absorbance at 252 nm as a measurement of end product accumulation, is provided in Table 20 below. Percentage increases in end product production are reported for 3 readings per trial.

TABLE 20

Effects of CAC on absorbance spectra of mecoprop.

| Treatment | Absorbance Maxima at Wavelength (λ) | | | Percent (%) increase in 252 λ (end-product formed) compared to Mecoprop control |
|---|---|---|---|---|
| | 230 | 252 | 280 | |
| Mecoprop | 1.72272 | 0.25619 | 1.21389 | Control comparison |

TABLE 20-continued

Effects of CAC on absorbance spectra of mecoprop.

| Treatment | Absorbance Maxima at Wavelength (λ) | | | Percent (%) increase in 252 λ (end-product formed) compared to Mecoprop control |
|---|---|---|---|---|
| | 230 | 252 | 280 | |
| Mecoprop + CAC (20X dilution) | 2.1708 | 0.88518 | 1.40078 | +346% |
| Mecoprop + CAC (40X dilution) | 1.85567 | 0.33366 | 1.30867 | +130% |

The absorbance for end-products generated by CAC when reacted with mecoprop increased 346% when the 20× dilution was used and 130% when the 40× enzyme dilution was used, confirming successful degradation of mecoprop by the free enzyme CAC.

Example 8

Free Enzymes Protect Against Epinastic Damage to Soybeans after Exposure to Herbicides Hydroxyphenylacetate monooxygenase (SEQ ID NO: 30), salicylate monooxygenase (SEQ ID NO: 21), 6-chloronicotinic acid chlorohydrolase (SEQ ID NO: 167), and chlorothalonil dehalogenase (SEQ ID NO: 168) were prepared as His-purified free enzymes as described above in Example 5. Each enzyme was added at a final concentration of 100 μM to 20 mL of buffer (50 mM HEPES, pH 7.0) containing 200 mg/L dicamba (CLASH, Nufarm). One buffer mixture was prepared for each enzyme. The enzymatic reaction solutions were then incubated at 37° C. with mixing at 400 rpm for 1 hour. Following the incubation period, the enzyme reaction solutions were applied exogenously as a spray (i.e., foliarly) to two-week old soybean plants. Control plants were sprayed with dicamba alone. Five days post-application, plants were scored for epinasty.

Figure 14:
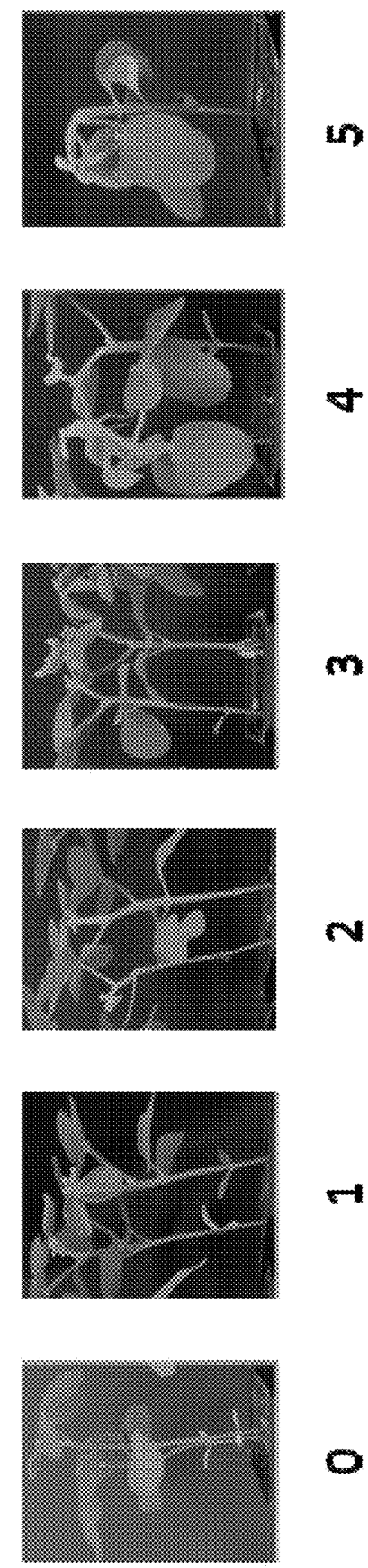
FIG. 14 provides photographs showing a scoring guide for epinasty.

"Epinasty" or "epinastic symptoms" refers to the outward and downward bending or curling of a plant part (e.g., stems or leaves), resulting from different growth rates on the upper and lower sides of the plant part. FIG. 14 depicts representative images of plants exhibiting epinasty of increasing severity. A score of 0 indicates no damage/epinasty. Scores of 1, 2, and 3 indicate progressively increasing severe stem bending. A score of 4 indicates stem bending and leaf curling. Score 5 indicates the most severe degree of epinasty, resulting in death of the plant.

This scoring system was used to evaluate growth and health of plants treated with dicamba alone or dicamba in combination with each of the detoxifying enzymes (hydroxyphenylacetate monooxygenase, salicylate monooxygenase, 6-chloronicotinic acid chlorohydrolase, and chlorothalonil dehalogenase). Results are shown in Table 21 below. Triplicate replicates were analyzed and scored for epinastic symptoms.

Dicamba provided as a final concentration of 200 mg/L to soybean plants resulted in severe injury and eventually death of the plants (epinastic score of 5). In contrast, all of the free enzymes applied to the plants provided at least some protection from the effects of dicamba. Salicylate monooxygenase completely protected the plants (epinastic score of 0) and hydroxyphenylacetate monooxygenase nearly completely protected the plants (epinasty score of 1). The chlorohydrolases also protected against dicamba injury, although to a lesser degree. Both 6-chloronicotinic acid chlorohydrolase and chlorothalonil dehalogenase treatments resulted in an epinastic symptom ranking score of 2.

TABLE 21

Epinastic symptom scoring on soybean plants following treatment with detoxifying enzymes to protect against dicamba injury.

| Dicamba Treatment | Ranking |
|---|---|
| Buffer Control (no dicamba) | 0 |
| Dicamba (CLASH), 200 mg/L | 5 |
| Hydroxyphenylacetate Monooxygenase + dicamba | 1 |
| Salicylate Monooxygenase + dicamba | 0 |
| 6-Chloronicotinic Acid Chlorohydrolase + dicamba | 2 |
| Chlorothalonil Dehalogenase + dicamba | 2 |

Example 9

Addition of a Colorimetric Chemical to Aid in Visualization of a Reaction

Hydroxyphenylacetate monooxygenase (SEQ ID NO: 30), salicylate monooxygenase (SEQ ID NO: 21), 6-chloronicotinic acid chlorohydrolase (SEQ ID NO: 167), and chlorothalonil dehalogenase (SEQ ID NO: 168) will be prepared as purified, His-tagged free enzymes as described above in Example 5. Each enzyme will be added at a final concentration of 100 µM to 20 mL of buffer (50 mM HEPES, pH 7.0) containing 200 mg/L dicamba (CLASH, Nufarm). One buffer mixture will be prepared for each enzyme. In addition, a pH reactive colorimetric substrate, such as phenol red, will be added to the reaction buffer. Release of H+ or Cl— from the reaction of the enzymes with the dicamba or other auxinic herbicide will cause a pH change, which will in turn cause a color change in the phenol red which has different colorimetric properties at different pHs. The enzymatic reaction solutions will be incubated at 37° C. with mixing at 400 rpm for 1 hour. The color change in the colorimetric substrate (e.g., phenol red) will be monitored by UV-Vis spectroscopy to monitor degradation of the herbicide.

Following the incubation period, the enzyme reaction solutions will be applied exogenously as a spray (foliarly) to two-week old soybean plants. Control plants will be sprayed with dicamba alone. Five days post-application, plants can be scored for epinasty as described in Example 8 (FIG. 14) or other herbicide damage.

This scoring system can be used to evaluate growth and health of plants treated with dicamba alone or dicamba in combination with each of the detoxifying enzymes (hydroxyphenylacetate monooxygenase, salicylate monooxygenase, 6-chloronicotinic acid chlorohydrolase, and chlorothalonil dehalogenase). Other scoring systems, such as yield measurements, can also be used to assess herbicide damage. This same system can be utilized with different herbicides and different enzyme systems.

Example 10

Addition of a Colorimetric Chemical and Second Enzyme to Aid in Visualization of a Reaction Hydroxyphenylacetate monooxygenase (SEQ ID NO: 30), salicylate monooxygenase (SEQ ID NO: 21), 6-chloronicotinic acid chlorohydrolase (SEQ ID NO: 167), and chlorothalonil dehalogenase (SEQ ID NO: 168) will be prepared as purified, His-tagged free enzymes as described above in Example 5. Each enzyme will be added at a final concentration of 100 µM to 20 mL of buffer (50 mM HEPES, pH 7.0) containing 200 mg/L dicamba (CLASH, Nufarm). One buffer mixture will be prepared for each enzyme. In addition, a second enzyme and an associated colorimetric substrate, such as β-galactosidase and bromo-gal (X-gal, 5-bromo-4-chloro-3-indolyl-β-D-galactopyranoside), will be added to the reaction buffer. β-galactosidase reacts with bromo-gal to create a blue end product. The dicamba detoxifying enzymatic reaction solutions will be incubated at 37° C. with mixing at 400 rpm for 1 hour. The β-galactosidase and bromo-gal concentrations can be adjusted so that the completion of the β-galactosidase: bromo-gal reaction and the completion of the dicamba detoxification enzyme:dicamba reaction are synchronized and the appearance of blue color corresponds with the completion of the dicamba detoxification. Other colorimetric enzyme:substrates can replace the β-galactosidases: bromo-gal; such as laccase:azo dye (decolorization); β-galactosidase:o-nitrophenol:galactoside, and others. The color change in the colorimetric substrate (bromo-Gal) will be monitored by UV-Vis spectroscopy to monitor degradation of the herbicide.

Following the incubation period, the enzyme reaction solutions will be applied exogenously as a spray (foliarly) to two-week old soybean plants. Control plants will be sprayed with dicamba alone. Five days post-application, plants can be scored for epinasty as described above in Example 8 (FIG. 14) or for other herbicide damage.

This scoring system can be used to evaluate growth and health of plants treated with dicamba alone or dicamba in combination with each of the detoxifying enzymes (hydroxyphenylacetate monooxygenase, salicylate monooxygenase, 6-chloronicotinic acid chlorohydrolase, and chlorothalonil dehalogenase). Other scoring systems, such as yield measurement, can be used to assess herbicide damage. This same system can be utilized with different herbicides and different enzyme systems.

Example 11

Addition of a Substrate and Second Enzyme to Regenerate NADPH/NADH to Aid in Restoring Cofactors of a Reaction Hydroxyphenylacetate monooxygenase (SEQ ID NO: 30), salicylate monooxygenase (SEQ ID NO: 21), or other NADH/NADPH-utilizing herbicide detoxification enzyme will be prepared as purified, His-tagged free enzymes as described above in Example 5. Each enzyme will be added at a final concentration of 100 µM to 20 mL of buffer (50 mM HEPES, pH 7.0) containing 200 mg/L auxinic herbicide (e.g., dicamba). One buffer mixture will be prepared for each enzyme type chosen. In addition, a second enzyme and substrate, such as sorbitol dehydrogenase (e.g., SEQ ID NO: 220) and sorbitol, glucose dehydrogenase (e.g., any of SEQ ID NOs. 185-190) and glucose, alcohol dehydrogenase (e.g., any of SEQ ID NOs. 197-201) and alcohol, or other combinations, will be added to the reaction buffer. The sorbitol dehydrogenase enzyme reacts with sorbitol, and converts NAD+ to NADH+ or NADP+ to NADPH, thus supplying the enzyme with the necessary cofactors (NADH+ or NADPH) it needs to detoxify the herbicide. The ratio of NADPH regenerating enzyme (e.g., sorbitol dehydrogenase) to substrate (e.g., sorbitol) can be adjusted so that the rate of NADH+ or NADPH production matches the rate of consumption of these cofactors by the herbicide-detoxifying enzyme. The herbicide detoxifying enzymatic reaction solutions will be incubated at 37° C. with mixing at 400 rpm for 1 hour. Exogenous NADH or NADPH, or NAD+ or NADP+, can be added to the reaction to supply excess cofactor to increase the rate of reactions.

Following the incubation period, the enzyme reaction solutions will be applied exogenously as a spray (foliarly) to two-week old soybean plants. Control plants will be sprayed with dicamba alone. Five days post-application, plants will be scored for epinasty as described in Example 8 (FIG. 14) or for other herbicide damage.

This scoring system can be used to evaluate growth and health of plants treated with dicamba alone or dicamba in combination with each of the detoxifying enzymes (e.g., hydroxyphenylacetate monooxygenase, salicylate monooxygenase). Other scoring systems, such as yield measurement, can also be used to assess herbicide damage. This same system can be utilized with different herbicides and different enzyme systems.

Example 12

Use of Auxinic Degrading or Sequestering Enzymes to Limit Effect of Sprayed or Volatilized Auxinic Herbicide Damage on Crops Hydroxyphenylacetate monooxygenase (SEQ ID NO: 30), salicylate monooxygenase (SEQ ID NO: 21), 6-chloronicotinic acid chlorohydrolase (SEQ ID NO: 167), and chlorothalonil dehalogenase (SEQ ID NO: 168) will be prepared as purified, His-tagged free enzymes as described above in Example 5. Each enzyme will be added at a final concentration of 100 µM to 20 mL of buffer (50 mM HEPES, pH 7.0). The enzyme solution and any required cofactors will be applied as a foliar spray on desired crops prior to herbicide application. After a set amount of time, the plants will be exposed to aqueous herbicide or auxinic herbicide volatile fractions. As the herbicide or volatilized herbicide encounters the plant with the detoxifying enzyme, the enzyme will act on the herbicide and prevent/limit the entry of active herbicide into the desired crops. Control plants will be sprayed with water or buffer alone, prior to the application of the herbicide. Five days or any desired time after herbicide application, plants can be scored for epinasty, as described in Example 8 (FIG. 14), or for other herbicide damage.

This scoring system can be used to evaluate growth and health of plants treated with dicamba alone or dicamba in combination with each of the detoxifying enzymes (hydroxyphenylacetate monooxygenase, salicylate monooxygenase, 6-chloronicotinic acid chlorohydrolase, and chlorothalonil dehalogenase). Other scoring systems, such as yield measurement, can also be used to assess herbicide damage. This same system can be utilized with different herbicides and different enzyme systems.

Example 13

Use of auxinic degrading or sequestering enzymes to protect soybeans from auxinic herbicides in spray tanks Chlorothalonil dehalogenase (ChD, SEQ ID NO: 168) was prepared as a crude cell lysate as described above in Example 5. Ten liters of 200 mg/L dicamba solution was recirculated in a spray tank using a set recirculation pump for 10 minutes until the dicamba was homogenously distributed throughout the tank. A concentration of 200 mg/L was selected since this concentration approximates the amount of dicamba residue left in a spray tank after a typical rinse following a 6 g/L typical dicamba use pattern. After ten minutes, a 50 ml sample of the dicamba solution was collected. A 5% v/v solution of the crude cell lysate containing the ChD enzyme was added and the tank was run for an additional 10 minutes. After 10 minutes, samples were collected from the tanks containing dicamba treated with the enzyme. Each of the samples was frozen immediately after collection from the tank. Samples were transported to the field on ice to ensure that enzyme activity was halted.

Figure 15:
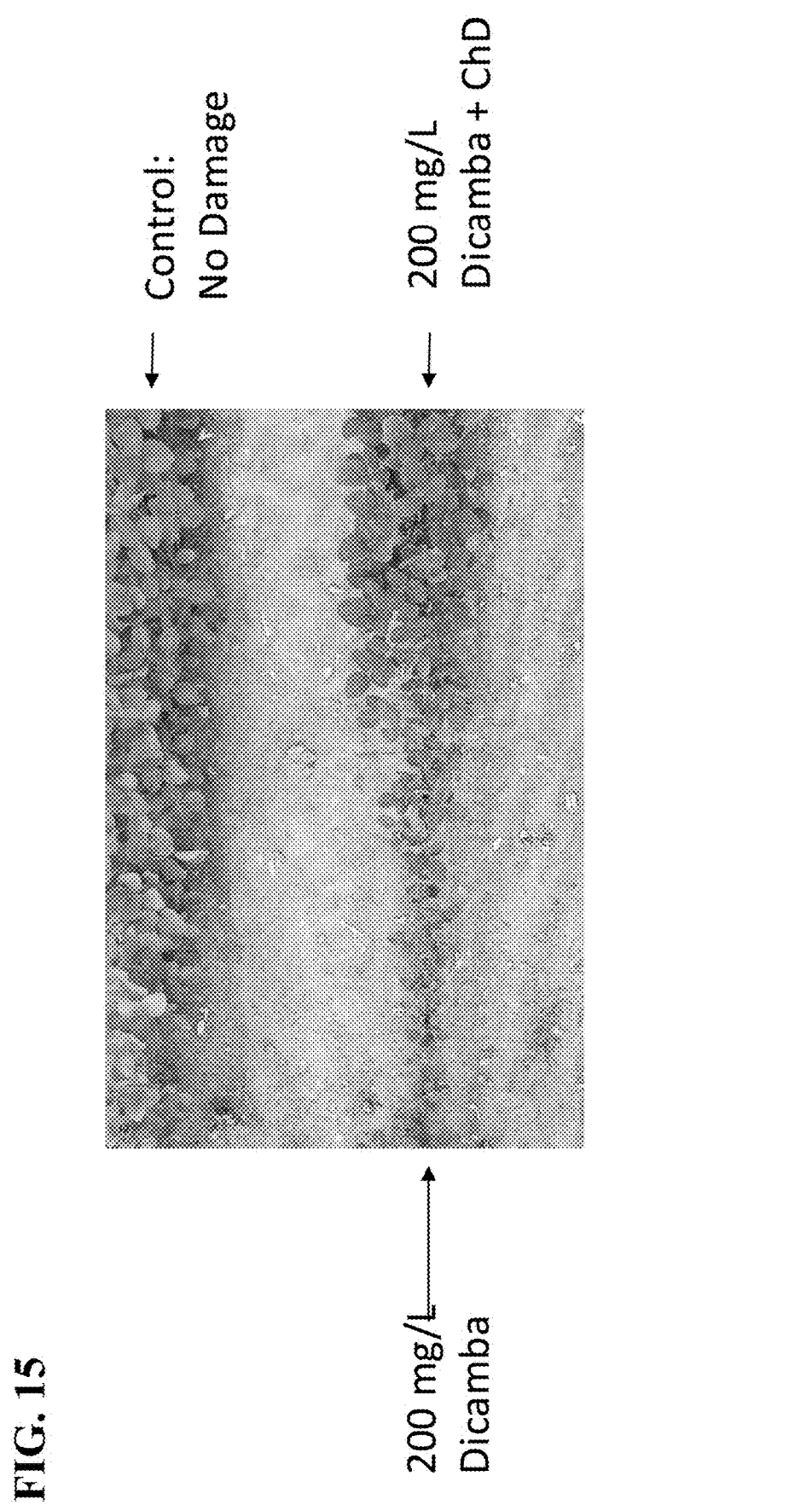
FIG. 15 provides a photograph showing soybean plants one week after spray application of water (control), dicamba (200 mg/L) or dicamba treated with chlorothalonil dehalogenase (dicamba+ChD). Soybean plants were treated at the V2-V3 stage of development.

In the field, 5 foot (1.67 meter) long sections of a soybean field planted in 30 inch (76.2 cm) rows were flagged and treated with 2 ml of the 50 ml tank-collected samples (either dicamba alone or dicamba treated with the crude cell lysates using a perfume mister. Control replicate plants did not receive any treatment. All plants were treated at the V2-V3 stage of growth, and the site was visited at one week after application. As shown in FIG. 15, the dicamba sample taken from the tank that was not treated with any enzyme (approximately 200 mg/L dicamba) caused significant damage to the crops, leading to a great reduction in the size and growth of the soybeans as compared to the untreated control. By contrast, the sample taken from the treated with the chlorothalonil dehalogenase (ChD)-containing crude cell lysate lead to almost complete protection of the plants. These plants continued to grow and resembled the control untreated plants. This same system can be utilized with different herbicides and different enzyme systems Example 14

Tank Detoxification of an Herbicide Using Salicylate Monooxygenase

Salicylate monooxygenase, for example SM1 (SEQ ID NO: 249), can be used effectively as a detoxification enzyme to reduce the herbicide dicamba in a spray tank after a full application at a recommended label dose (6,000 mg/L to 12,000 mg/L) depending on the commercial dicamba selected for use and the crop selected for the application.

A "safe zone" concentration of an herbicide (dicamba) in the rinsate, or remaining with the agricultural spray equipment, is the concentration that can be applied to a plant or an environment and not cause injury or harm to the plant or to the environment. Safe zone levels can be accomplished by the addition of an herbicide detoxifying enzyme such as salicylate monooxygenase to a tank for the detoxification (removal) of dicamba using the recommended procedures as described in Table 22. In this particular case with a spray application using dicamba, the safe zone that has been established is at or below 15 mg/L. The tank cleaning procedure described in Table 22 is used to achieve a safe zone level of dicamba in a tank. Table 22 provides sample cleaning procedures using an herbicide detoxification enzyme, in this particular case salicylate monooxygenase, to remove dicamba from a tank rinsate after a spray application using dicamba has been performed. The procedures reported below are for cleaning a tank after a spray application with dicamba has been performed using starting concentrations of 6,000 or 12,000 mg/L and result in levels of dicamba below the "safe zone" requirements.

TABLE 22

Spray tank cleaning procedure using salicylate monooxygenase to remove dicamba after a spray application

| Tank Cleaning Protocol Steps Used to Detoxify Dicamba (1000 L Spray Tank) | Concentration of Dicamba Remaining in a Spray Tank After Cleaning Procedure | Concentration of Dicamba Remaining in a Spray Tank After Cleaning Procedure |
|---|---|---|
| Remaining volume of dicamba in tank after the spray application was completed = 16.67 L | 6,000 mg/L | 12,000 mg/L |
| Add SM1 detoxifying enzyme to the concentrated herbicide in the tank and adjust tank volume with water to 100 L | 1000 mg/L | 2000 mg/L |
| Dicamba is degraded by SM1 enzyme | 100 mg/L | 200 mg/L |
| Tank is refilled using water to 1000 L | 1.67 mg/L (safe zone) | 3.34 mg/L (safe zone) |

Example 15

Engineering the Active Site of Salicylate Monooxygenase to Generate a Highly Efficient Enzyme to Degrade Dicamba Salicylate monooxygenase (EC 1.4.13.1) is an enzyme that belongs to the family of oxidoreductases, specifically those acting on paired donors, with $O_2$ and catalyzes the reversible reaction as shown below that incorporates or reduces oxygen. Salicylate monooxygenase uses NAD(P)H and FAD as cofactors in the reaction, which results in the production of the end product catechol.

salicylate+NAD(P)H+2H$^+$+$O_2$ ⇌ catechol+NAD(P)$^+$+$H_2O$+$CO_2$

Salicylate monooxygenase is effective in the detoxification of dicamba. In the presence of dicamba as a substrate, salicylate monooxygenase can react as follows to produce the possible end products in the reactions as shown below:

Dicamba+NAD(P)H+2H$^+$$O_2$ → chloroanisole end products(3-chloroanisole,2-chloroanisole, or 2,5-dichloroanisole)+NAD(P)$^+$+$H_2O$ or:

Dicamba+NAD(P)H+2H$^+$$O_2$ → 3,6-Dichloro-2-methoxyphenol+NAD(P)$^+$+$H_2O$+$CO_2$ The resulting end products of this forward reaction can alternatively be referred to as 3,6-Dichloro-2-methoxyphenol; 2-Methoxy-3,6-dichloro-phenol; or 3,6-dichloroguaiacol ($C_7H_6Cl_2O_2$).

Figure 16:
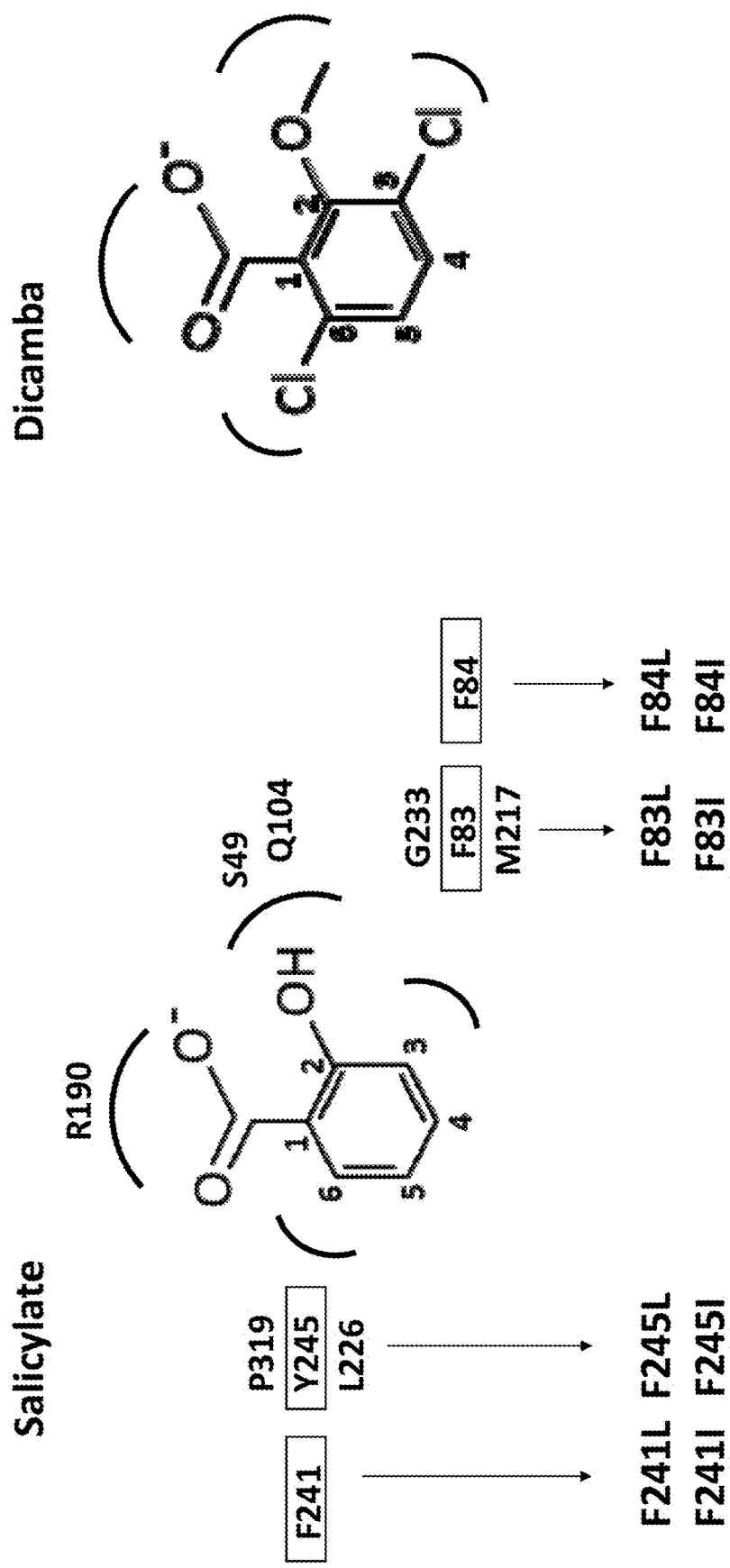
FIG. 16 provides a structure of salicylicate (left) compared to dicamba (right). Arcs on each structure indicate functional groups that may interact with the salicylic monooxygenase binding site. Targeted mutations made to salicylic monooxygenase to promote the binding of dicamba are shown on the left an enzyme can include, but is not limited to immobilization by adsorption, covalent binding, use of a high affinity tag, or entrapment.

An X-ray crystal structure of salicylate from salicylate hydrolase obtained from *Pseudomonas putida* (Uemura T. et al., 2016, "The catalytic mechanism of decarboxylative hydroxylation of salicylate hydrolase revealed by crystal structure analysis of 2.5 Å resolution", Biochemical and Biophysical Research Communications 469: 158-163) was used for predictive modeling to locate the active site for salicylate hydrolases/monooxygenases. The active site of monooxygenases that catalyze reactions with hydroxy or halo substituted benzoates have an active site that is specifically designed to accommodate such substrates. These active sites contain a largely hydrophobic pocket with located polar regions that are involved in binding of the carboxylate or hydroxyl groups and/or catalysis. The natural substrate of salicylate monooxygenase (SM1) is salicylic acid, which is a benzoic acid with a hydroxyl substitution on position 2 of aromatic ring. In contrast, dicamba is a benzoic acid with three aromatic substitutions: a methoxy group on position 2, and chloride groups on positions 3 and 6. The main differences between salicylic acid and dicamba are aromatic substitutions at positions 3 and 6. These differences suggest that the space at the active site of SM1 (SEQ ID NO: 251), ideal for salicylic acid was altered to freely accommodate a molecule of dicamba. To preferably favor and bind to dicamba binding, the active site of SM1 was reengineered to accommodate a more efficient binding and for increased activity of SM1 to degrade dicamba. In the structure of SM1-salicylate complex, two residues, F84 and Y245, are the closest residues to the salicylate's aromatic positions 3 and 6, respectively. Thus, site mutations to leucine or to isoleucine were introduced at F84 and F245 positions. These mutations are predicted to provide room for dicamba's chloride groups in SM1 enzyme active site (FIG. 16). In addition, predictions for modifications were also generated to salicylate monooxygenase SM3 (SEQ ID NO: 258) and were also modeled to modify amino acid residues in the active site to increase the specificity for binding to dicamba. In the structure of SM3-salicylate complex, two residues, F83 and F241, are the closest residues to the salicylate's aromatic positions 3 and 6, respectively. Thus, site mutations to phenylalanine at these two positions, F83 and F241 are also predicted to provide room for dicamba's chloride groups in SM3 enzyme active site (FIG. 16).

Point mutations were generated from salicylate monooxygenase (SM1) to produce the derived variants in Table 3A and 3B. In Fusion (Takara) cloning was used to generate point mutations. Overlapping forward and reverse primers, each with a single or double base mismatch to create a codon change, were designed. For example, codon 84 of SM1 (TTT) was changed to TTA for the conversion of F84 to L and was changed to ATT for the conversion of F84 to I. Using these primers, a single PCR reaction was performed to amplify the entire pHT43-P69-SM1 construct with the desired mutations. Standard In Fusion cloning and transformation methods were performed as described in the cloning of SM1 to generate A64 strains expressing the mutated SM1 enzymes as described in Example 16.

Example 16

Cloning and Expression of Pesticide Detoxification Enzymes

Cloning and Expression of Salicylate Monooxygenase (SM1)

The procedures for cloning and expressing salicylate monooxygenase as described herein, can be used to clone any of the pesticide detoxifying enzymes of the invention. Salicylate monooxygenase (SM1; SEQ ID NO: 243) was cloned from *Bacillus cereus* strain B377. The expression plasmid containing salicylate monooxygenase: pHT43-P69-SM1 was generated using In Fusion cloning reactions (In Fusion Cloning Kit, Takara). Primers S779 (5') (SEQ ID NO: 285) and S901 (3') (SEQ ID NO: 286) were used to amplify the vector backbone, and then primers S997 (5') (SEQ ID NO: 289) and S998 (3') (SEQ ID NO: 290) were used to amplify the SM1 gene sequence using polymerase chain reaction (PCR) methods (Table 23). PCR products were purified with the Wizard SV Gel and PCR Clean-up system (Promega Corporation) and then digested using a restriction enzyme DpnI for 1 hour at 37° C. The digested PCR products were purified again with the same Wizard SV Gel kit. Following the clean-up procedure, 20 ng each of vector backbone and the SM1 gene insert were combined with 1 µl of In Fusion Premix (Takara) solution in a 5 µl total reaction. The reactions were incubated at 50° C. for 15 min and then chilled on ice. The entire reaction was transformed into Stellar E. coli competent cells (Takara) by using a heat shock treatment at 42° C. followed by recovery at 37° C. in Luria-Bertani (LB) broth, and plating on LB-ampicillin agar plates. The plates were incubated at 37° C. overnight. Colonies with the correct gene insert sequences were identified by PCR and sequencing.

TABLE 23

Primer Sequences

| Primer | SEQ ID NO. |
|---|---|
| S779 (5') | 285 |
| S901 (3') | 286 |
| S997 (5') | 289 |
| S998 (3') | 290 |

The pHT43-P69-SM1 plasmid was isolated from E. coli with the Wizard SV Plus Minipreps DNA Purification System (Promega Corporation). A concentration of 120 ng of the pHT43-P69-SM1 plasmid was then transformed into Bacillus subtilis strain A64 competent cells using electroporation. The cells were electroporated in a 1 mM cuvette with the following parameters: 2.35 kV, 200 ohms, 25 µFD. The cells were recovered in 500 µL of 2×YT-chloramphenicol media supplemented with 0.5 mM sorbitol and 0.38 mM mannitol at 37° C. for 3 hours. The cells were then plated on N-chloramphenicol agar plates. Colonies with the correct insert sequence were identified with PCR, and sequencing confirmation which was used to designate the cloned sequence as SM1 (SEQ ID NO: 243).

To express the SM1 enzyme, the sequence confirmed culture was streaked on an N-chloramphenicol agar plate. The next day, a single colony was used to inoculate a 5 mL N-chloramphenicol liquid culture, which was incubated at 37° C. overnight with 300 rpm shaking. The following day, this culture was used to start a 30 mL 2×YT-chloramphenicol liquid culture in a flask at OD600=0.1. When the OD600 reached 0.7, 30 uL of 100 mM isopropyl β-D-1-thiogalactopyranoside (IPTG) (range can include 0.1 mM to 1.0 mM) was added to the culture to get a final concentration of 0.1 mM IPTG for induction of SM1 enzyme expression. The culture was then transferred to a 30° C. incubator with 300 rpm shaking for an overnight induction of enzyme expression. The SM1 enzyme productions were then tested in dicamba degradation assays.

Example 17

Dicamba Degradation Assays Using Salicylate Monooxygenase (SM1)

Dicamba degradation reaction buffer was made by adding a solution of dicamba equal to 600 mg/L diluted from Clash™ (Nufarm US) product. The dilution to achieve 100 ppm or 100 mg/L was made in 25 mM HEPES pH 7 in a 10 mL total volume. The SM1 enzyme production produced as previously described were divided up into aliquots, centrifuged, and 100 µL of the Bacillus subtilis (A64) supernatant containing the SM1 expressed enzyme was added to the dicamba reaction buffer along with 0.5 mM NADH in a beaker with a stir bar. A Bacillus subtilis (A64) control reaction, which was supernatant with no SM1 enzyme was performed in parallel. The reactions were incubated at 37° C. with 400 rpm stirring for two hours. Aliquots of the reactions were collected at time 0 (T0), 1 hour, and 2 hours, and frozen at −80° C.

Quantification of Dicamba Using HPLC Methods

Samples from the dicamba degradation assays were further diluted to an expected concentration of 35 ppm. HPLC column (Kinetex® 5 µm C18 100 Å, LC Column 50×4.6 mm) was equilibrated for 15 minutes with 35% acetonitrile and 65% 10 mM ammonium acetate with 0.1% formic acid in water. A volume of 10 µL of each sample was injected into Waters 2695 Separations Module with a 2996 Photodiode Array Detector. Samples were run isocratically (35% acetonitrile and 65% 10 mM ammonium acetate with 0.1% formic acid in water) for 2 minutes. Analysis was carried out at 204 nm and compared to a 5-point 2-fold standard curve starting at 50 ppm dicamba. The treatments from the dicamba degradation assays are fully described in Table 24 below. An average of 3 measurements was run for each treatment sample. They are reported as absolute dicamba remaining from the initial 35 ppm starting concentration and the percent dicamba concentration relative to the T0 dicamba control treatment.

TABLE 24

Salicylate monooxygenase can reduce dicamba concentration over time

| Treatment | Time (hours) | Dicamba (ppm) | Percent Dicamba Concentration Relative to T0 control |
|---|---|---|---|
| Dicamba | 0 | 34.9 | 100.0 |
| Dicamba | 1 | 39.7 | 113.6 |
| Dicamba + A64 supernatant + NADH | 1 | 34.6 | 99.1 |
| Dicamba + SM1 + NADH | 1 | 30.0 | 85.9 |
| Dicamba | 2 | 37.0 | 106.0 |
| Dicamba + A64 + NADH | 2 | 36.1 | 103.3 |
| Dicamba + SM1 + NADH | 2 | 29.4 | 84.3 |

TABLE 25

Salicylate monooxygenase can reduce dicamba concentration at physiologically relevant pH

| Treatment | Percentage Change in Degradation of Dicamba After 1 hour Compared to Control | Percentage Change in Degradation of Dicamba After 2 hours Compared to Control |
|---|---|---|
| Dicamba (100 ppm) | 0% | 0% |
| Dicamba (100 ppm) + NADPH pH 7 | 1.8% | 0.5% |
| Dicamba (100 ppm) + SM1 + NADPH pH 7 | 15% | 55% |
| Dicamba (100 ppm) + SM1 + NADPH pH 8 | 54% | 42% |

*Dicamba degradation was measured using the methods that were described previously using the HPLC to quantify dicamba concentration in solution.

Quantification of dicamba indicates the presence of SM1 leads to degradation of dicamba in solution. The A64 supernatant control (without enzyme) shows no decrease in dicamba concentration over 2 hours. The salicylate monooxygenase (SM1) samples showed a decrease in dicamba concentration to 84.3% of the T0 concentration at 2 hours from the start of the reaction (Table 25). Addition of SM1 in the dicamba degradation assays resulted in a repeatable almost 16% reduction or degradation of the dicamba product. Since the starting concentration in the original reaction was 600 ppm, this means that approximately 100 ppm was degraded in this reaction. Table 25 also shows substantial decreases in the dicamba concentration for the sample reactions that contained the SM1 detoxification enzyme with as much as a 54% reduction in the concentration of dicamba with SM1+NADPH at pH 8.0 after 1 hour and a 55% decrease seen with the reaction containing SM1+NADPH at pH 7.0 after 2 hours.

UV Absorbance Spectra of Dicamba Reaction Products

Salicylate monooxygenase used in detoxification reaction with dicamba generates the oxidation of the NADH cofactor to produce $NAD^+$ and therefore a decrease in the amount of NADH is correlated to the activity of SM1 and the enzyme's effectiveness to degrade dicamba. To examine the UV absorbance spectra of the SM1/dicamba reaction products generated from the dicamba degradation assay reactions as described above, aliquots were thawed, and 100 L of each sample was added to a 96-well UV-Star® UV transparent microplate (Greiner Bio-One International). Spectra were read from 200-700 nm with a BioTek SYNERGY HTX plate reader (BioTek Instrument Inc.).

NADH exhibits an absorbance peak at 340 nm. An NADH standard curve was generated (Amax 340 nm) using varying concentrations of NADH in the expected ranges produced with SM1 reactions with at a starting concentration of dicamba at 100 ppm. The NADH standard curve resulted in a linear concentration range with an equation of: y=3.4161x–0.1024 and an $R^2$=0.9993. NADH disappears when the molecule is oxidized to $NAD^+$. Based on the absorbance reading at 340 nm the concentration of NADH in the presence of dicamba (100 ppm) reactions with salicylate monooxygenase (SM1) was oxidized and thus resulted in a lower absorbance value for the treatment combination of SM1 (+NADH) with dicamba when compared to A64 filtrate (+NADH) used as the background control. The results presented in Table 26 show that dicamba degradation had occurred when SM1 was present in the sample reactions.

TABLE 26

Salicylate monooxygenase reactions for dicamba degradation as measured by the oxidation of NADH

| Treatment | Time (hours) | Absorbance at 340 nM |
|---|---|---|
| Dicamba | T0 | 0.056 |
| Dicamba | 1 | 0.059 |
| Dicamba + A64 + NADH | 1 | 1.541 |
| Dicamba + SM1 + NADH | 1 | 0.753 |
| Dicamba | 2 | 0.058 |
| Dicamba + A64 + NADH | 2 | 1.532 |
| Dicamba + SM1 + NADH | 2 | 0.732 |

Figure 2:
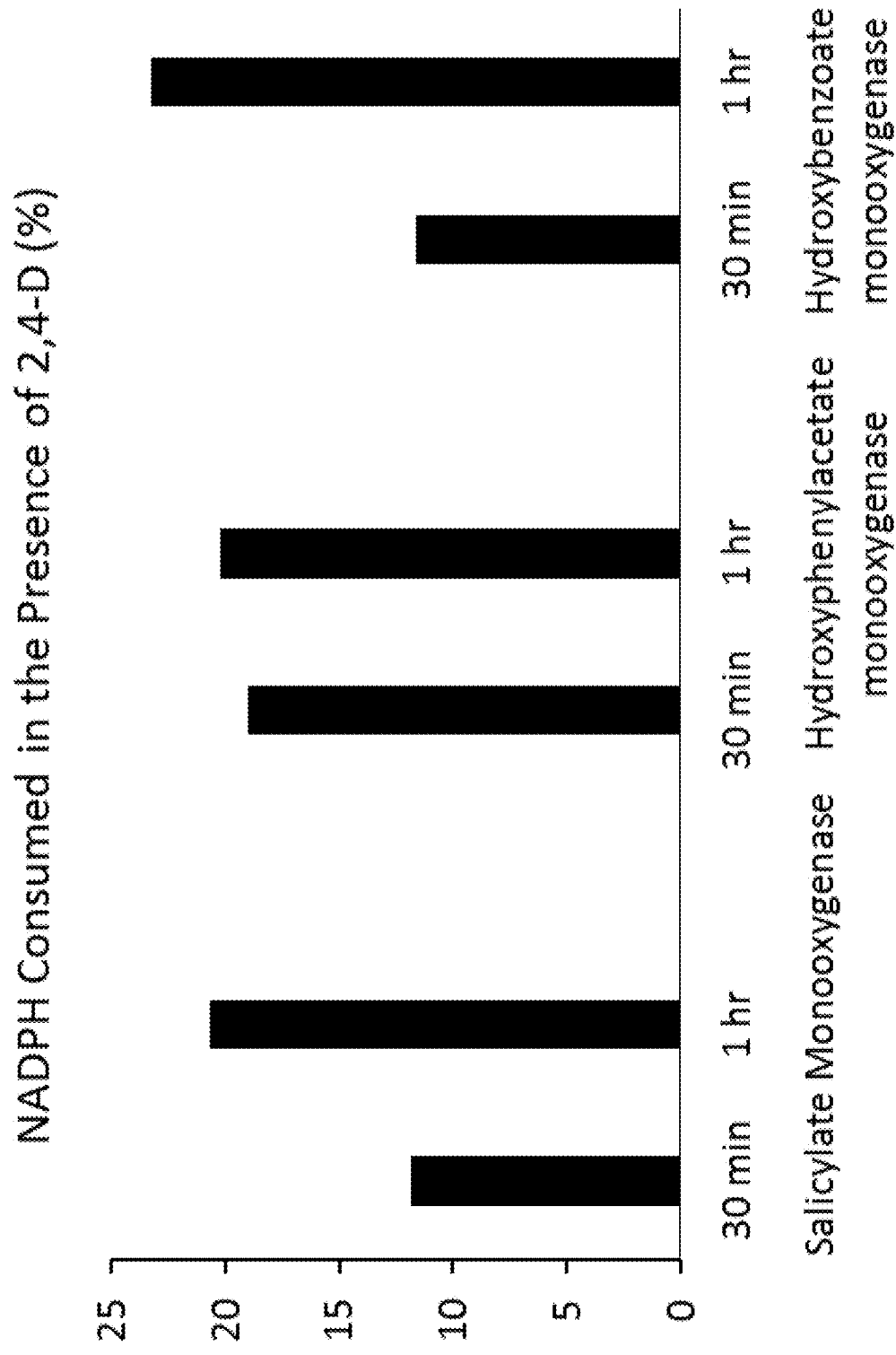
FIG. 2 is a bar graph of illustrative results showing the percent of NADPH consumed during detoxification of 2,4-D by immobilized salicylate monooxygenase (SM), immobilized hydroxyphenylacetate monooxygenase (HPAM), or immobilized hydroxybenzoate monooxygenase (HBM), over the course of 30 minutes or one hour.
Figure 17:
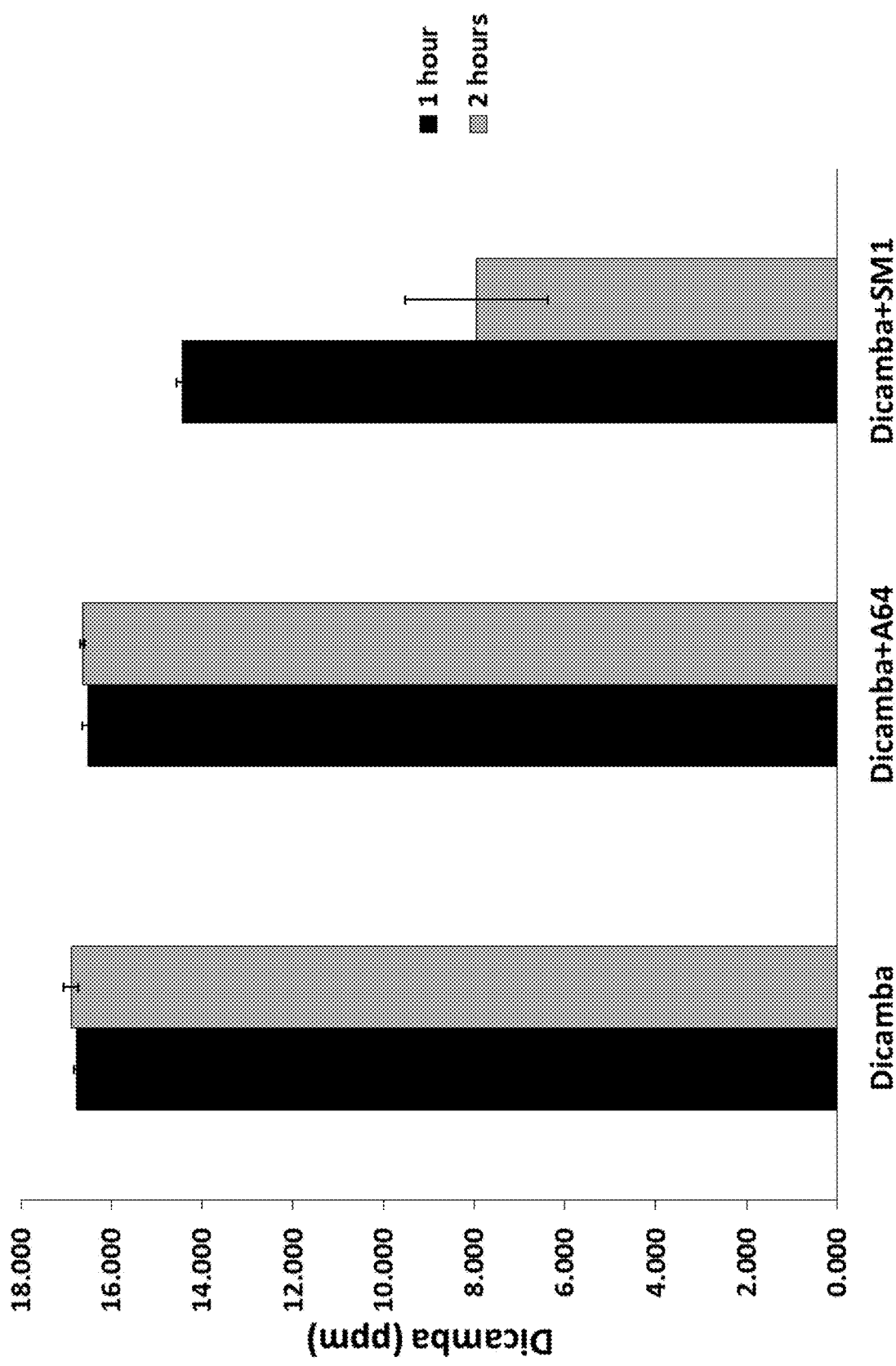
Figure 18:
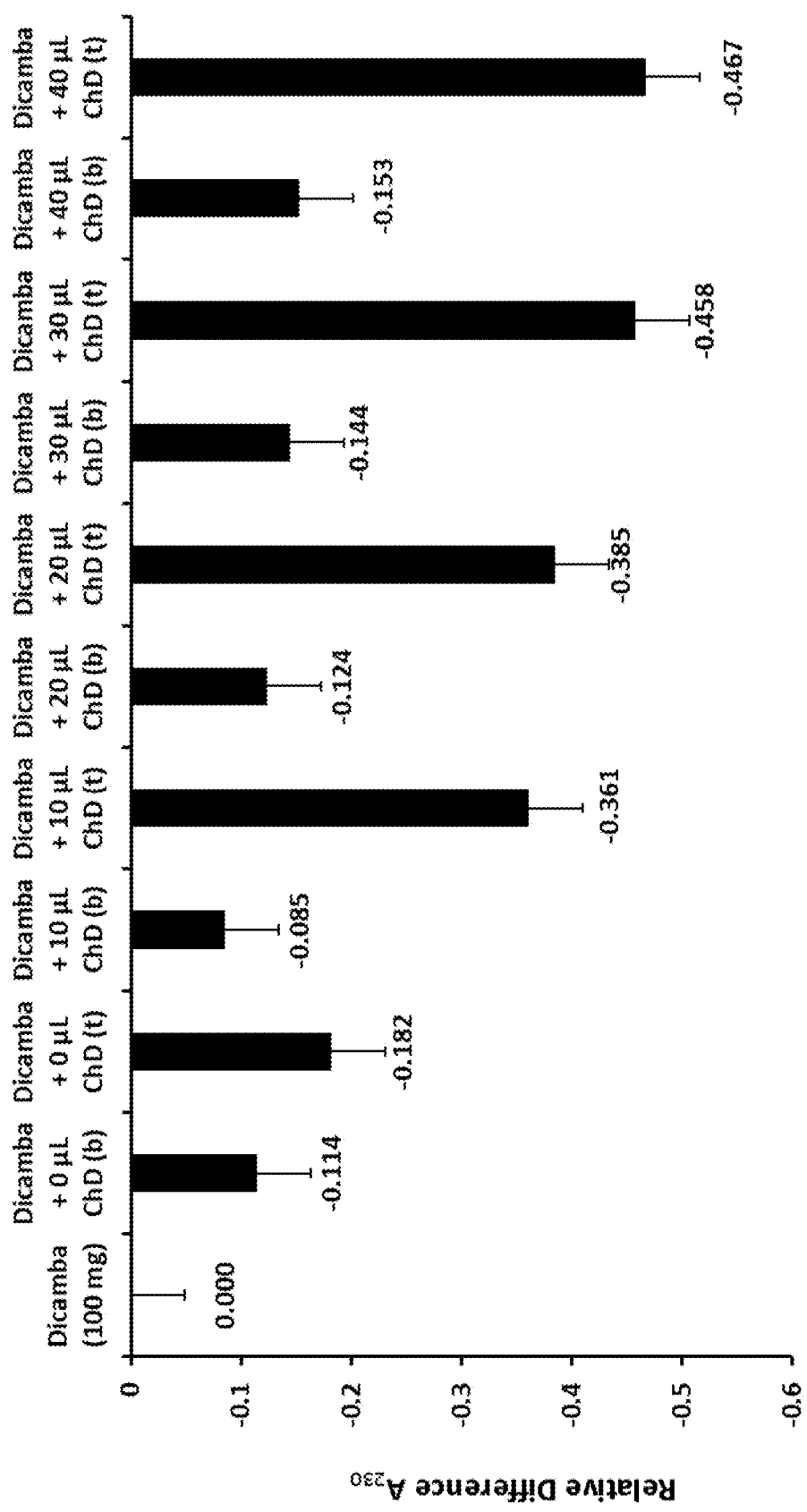

Another dicamba degradation assay using the same HPLC methods to quantify dicamba as (described above) was conducted to determine the dicamba remaining in solution in reactions with and without the SM1 enzyme. The assay was conducted using 3 treatments, a dicamba control (or dicamba alone), dicamba provided with A64 filtrate and dicamba in combination with the SM1 enzyme. All treatments had a starting concentration of 100 ppm or 100 mg/mL dicamba diluted from CLASH (Nufarm US) product in HEPES buffer pH 7.0 with addition of 0.5 mM NADH. The SM1 enzyme treatment added to dicamba was added at a volume of 250 µL of SM1 enzyme obtained from the original production as previously described. Samples from the dicamba degradation assays were taken at 1 and 2 hours after the initial assays (T0) were initiated. The samples were subsequently diluted prior to analysis using HPLC to what would be equivalent to a starting concentration of approximately 16 ppm for the T0 samples. The HPLC results as reported in FIG. 2 are the average of 3 sample measurements. There was no difference in dicamba concentration between the dicamba and dicamba with A64 filtrate (background control). The dicamba treatment containing the SM1 detoxifying enzyme had decreased concentrations after 1 hour of incubation with the enzyme and substantially decreased concentration after 2 hours of incubation with the SM1 enzyme of approximately 50% (FIG. 17).

Example 18

Protection of Soybean Plants Using Salicylate Monooxygenase Combined with Dicamba Reaction Products A study was conducted to evaluate the use of salicylate monooxygenase (SM1) detoxifying enzyme to protect soybean plants from dicamba damage. The SM1 enzyme combined with dicamba generated the dicamba degradation reaction products using methods as previously described. These SM1-dicamba degradation products were applied to soybean seedlings (variety, Morsoy Xtra). The soybean plants were grown from seed (2 seeds per pot) in an environmentally controlled growth room under conditions of approximately 300 µmol $m^{-2}$ $s^{-1}$ (light photons) for a 13/11 light/day cycle and a 21° C. day/15° C. night temperature range until the V1 stage of development (12 days). Aliquots of the salicylate monooxygenase (SM1) reactions with dicamba were generated in dicamba degradation assays with and without the detoxifying enzyme as previously described. The samples were thawed and diluted 1:24 in water with 0.01% (v/v) SILWET L-77, a non-ionic organosilicone surfactant. A volume of 100 µL of each reaction product was then applied to the trifoliate leaves of each soybean plant with a total of 6 plants per treatment. The plants were scored based on trifoliate damage using the scale as described in Table 27. The average damage score for the dicamba treatments with and without the SM1 enzyme and combined with an NADH cofactor are reported in Table 28.

TABLE 27

Trifoliate damage scoring based on applications with dicamba herbicide

| Damage Score | Description of damage to trifoliate leaves |
|---|---|
| 0 | No visible damage |
| 1 | youngest trifoliate has moderate yellowing or curling |
| 2 | youngest trifoliate has moderate yellowing or curling |
| 3 | youngest trifoliate has severe yellowing or curling |
| 4 | youngest trifoliate is completely dead or shriveled |
| 5 | plant is completely necrotic (dead) |

TABLE 28

Salicylate monooxygenase protects soybean
trifoliate leaves from dicamba damage

| Treatment | Time (hours) | Average Trifoliate Damage Score |
|---|---|---|
| Untreated Control | 2 | 0 |
| Dicamba (100 ppm) | 2 | 4 |
| Dicamba (100 ppm) + A64 + NADH | 2 | 4 |
| Dicamba (100 ppm) + SM1 + NADH | 2 | 2.8 |

Table 28 provides a scoring of dicamba damage on the trifoliate leaves of soybean using 2 hours post application. The untreated control plants had no visible damage and received a score of 0. The dicamba treatment alone was 4 after 2 hours of the dicamba spray application. The dicamba treatment (100 ppm) with NADH in the A64 filtrate or background A64 control (used to produce the SM1 enzyme) also resulted in a damage score of 4. However, when the dicamba (100 ppm) treatment was included with the SM1 enzyme and the NADH cofactor there was protection provided to the trifoliate leaves and a reduction seen in the damage score of 2.8.

Example 19

Treatment of Soybean Seed with Chlorothalonil Dehalogenase Protect Plants from Damage of Simulated Spray Drift Dicamba and 2,4-D Herbicides Soybean (variety Asgrow AG4034) seed received a seed treatment with chlorothalonil dehalogenase (SEQ ID NO: 169) enzyme obtained from a production batch produced in a manner similar to that was described previously to generate the SM1 enzyme. Seed treatments were applied prior to planting. Then seeds were treated with over the top applications of the dicamba herbicide (CLASH; Nufarm US) or 2,4-D (WEEDAR64; Nufarm US) to simulate concentrations of dicamba and or 2,4-D from spray drift occurrences after planting and may cause damage at or after seedling emergence. Sixty individual seeds were coated with 3 uL each of the ChD enzyme per each herbicide (dicamba or 2,4-D) treatments and 60 seeds were left untreated (control). Seeds were then planted directly into 39.7 cm$^3$ pots containing a mixture of 3:1 Timberline top soil to MIRACLE GRO potting soil at a depth of 2.54 cm, with 2 seeds per pot. After planting, 50 mL of room temperature water was added to each pot to allow for germination. Dicamba herbicide (CLASH) was applied immediately after the first watering with a spray bottle containing a solution of 100 ppm (100 mg/mL) in water at a rate equivalent to 10.2 Fl. oz/Ac or 745.4 mL/Ha. The 2,4-D (WEEDAR64) herbicide treatment was also applied immediately after the first watering with a spray bottle containing a solution of 500 ppm (500 mg/mL) in water and also applied at a rate equivalent to 10.2 Fl. oz/Ac or 745.4 mL/Ha. The treatments were then placed in a greenhouse and randomized using a complete block design to adjust for temperature and lighting differences. The plants received the same day/night cycle that would occur in the field on a summer's day. After the initial watering, plants received the same watering regimes. The soybean plants that received each of the dicamba or 2,4-D herbicide treatments were compared to those that first received the seed treatment with the chlorothalonil dehalogenase (ChD; SEQ ID NO: 169) and to those that only received the water control. The soybean plants were then harvested and measured for biomass and plant height 4 weeks after planting. The results for the percentage increase in total biomass compared to the untreated or water control seed are reported for both over the top treatments using dicamba and 2,4-D as shown in Table 29.

TABLE 29

Seed treated soybean provided with chlorothalonil dehalogenase to protect plants from
damage that was caused simulated spray drift application using dicamba or 2,4-D

| Treatment | Percentage Increase in Total Plant Biomass Compared to Untreated Seed (Dicamba; Clash ™ Spray Treatment) | Percentage Increase in Total Plant Biomass Compared to Untreated Seed (2,4-D; Weedar ®64 Spray Treatment) |
|---|---|---|
| Chlorothalonil dehalogenase *Pseudomonas* species (SEQ ID NO: 169) | +149% | +6% |

The percentage increase in total biomass was substantially increased for soybean plants that received seed treatments with the chlorothalonil dehalogenase (SEQ ID NO: 169) enzyme as compared to plants grown from seed that received a water only control treatment and the over the top herbicide spray just after planting. The soybean seed treatment with the ChD enzyme that then received the over the top application of dicamba produced plants with +149% more total biomass as compared to the water control. The chlorothalonil dehalogenase seed treatment also protected soybean plants from drift that may occur from an herbicide spray application using 2,4-D. Soybean seed that received the ChD enzyme provided as a seed treatment prior to planting and then received an over the top application of 2,4-D produced plants with +6% more total biomass as compared to the water control (Table 30).

TABLE 30

Seed treatment with chlorothalonil dehalogenase protects
soybean plants from damage was caused simulated spray drift
application using dicamba or 2,4-D and promotes growth

| Treatment | Percentage Increase in Plant Height Compared to Untreated Seed (Dicamba; Clash ™ Spray Treatment) | Percentage Increase in Plant Height Compared to Untreated Seed (2,4-D; Weedar ®64 Spray Treatment)) |
|---|---|---|
| Chlorothalonil dehalogenase *Pseudomonas* species (SEQ ID NO: 169) | +35% | +6% |

Soybean seed that received the ChD treatment and the over the top spray application with dicamba produced plants that had a +35% increase in plant height as compared to plants grown from seed that received a water control treatment. Similarly, soybean seed that received the ChD treatment and the over the top application of 2,4-D produced plants with +6% more increases in plant height as compared to plants grown from seed that received a water control treatment.

Example 20

Proposed Mode of Action for Chlorothalonil Dehalogenase, Sequestration of an Herbicide to Protect Plants Against Damage Sequestration or immobilization of an herbicide, such as dicamba, is one mode of action proposed for the chlorothalonil dehalogenases (ChD) used to protect a plant like soybean by physically removing from the target site and preventing or restricting the movement of the herbicide into the plant. This type of mode of action is distinct and differs from the detoxification or the degradation of an herbicide, such as dicamba by salicylate monooxygenase (SM1). The sequestration of the dicamba prevents the herbicide from causing harmful effects on soybean plants is shown in FIG. 15.

To examine the mode of action for ChD, formulated dicamba (CLASH) was diluted with water from the concentrated rate to a concentration of dicamba at 100 mg/L. A volume of 100 uL of the dicamba solution was added to six, 1.7 mL Eppendorf tubes. To four of the tubes, enzyme solution was added to four of the tubes at 10, 20, 30, and 40 uL rates. The two tubes without the enzyme solution served as controls for the experiment. When the enzyme was added, five of the tubes (one of the 0 uL enzyme tubes, and all of the tubes with the enzyme added) were placed in the Eppendorf Thermomixer R for 5 minutes, at 37° C., and 800 rpm. After the incubation period, the tubes were removed from the heat and placed on ice to stop the reaction. Once cooled, 500 uL of all six reaction mixes were pipetted into new tubes, containing a 3 kDa filter which retained any of the enzyme and dicamba that had formed a complex, while letting the free dicamba flow through the column to the bottom fraction. These new tubes were spun at 1400 rpm for five minutes. When the spin was completed, 100 uL of the top and bottom fractions were added into a 96-well UV-Star plate. Spectral readings were then taken from 200 nm to 340 nm. The reads for the buffer alone controls were subtracted from the experimental values. The relative difference between the control without enzyme added and the experimental samples with enzyme added was calculated at 230 nm. In FIG. 18, negative values indicate that the experimental sample has a lower absorbance at 230 nm than the control without enzyme added and lower than expected dicamba concentration. Since only dicamba that is unbound to ChD could pass through the filter, lower absorbance values in the bottom fraction indicate that some of the dicamba in solution was bound to the enzyme. A dose-dependent effect was observed in which as a higher concentration of ChD enzyme was added, more dicamba was in a bound state (FIG. 18), Thus, the ChD enzyme can bind to the dicamrba molecule and prevent its effects on plants by sequestration.

At physiologically relevant pH levels, herbicide detoxification enzymes such as chlorothalonil dehalogenase (ChD) can be combined with metal ions such as $Fe^{3+}$, $Fe^{2+}$, $Zn^{2+}$, $Mn^{2+}$, $Cu^{2+}$, $Cu^{+}$ and $Mg^{2+}$ to assist with the sequestration or immobilization of certain herbicides (for example, dicamba or glyphosate) and affect (reduce or prevent) plant uptake of the herbicide. Such enzymes, for example ChD can be used to further provide protection from herbicide damage.

Soybean plants (variety Morsoy Xtra) were planted in Timberline soil (2 seeds per pot) and grown for 12 days under controlled environmental growth conditions: 300 $\mu mol\ m^{-2}\ s^{-1}$ (light photons) for a 13/11 light/day cycle and a 21° C. day/15° C. night temperature range until the V1 stage of development. Bioassay experiments were conducted using the V1 soybean plants where varying concentrations of dicamba (100 ppm, 150 ppm, and 200 ppm) were reacted with ChD enzyme, and then the reaction products were applied to examine the effectiveness of the ChD enzyme to protect young soybean plants from damage from the dicamba herbicide.

To further examine if the addition of metal ions could increase the protection of soybean from dicamba damage, the ChD (SEQ ID NO: 169) enzyme was applied with $MnSO_4$ (50 mM) in treatment combinations with the varying concentrations of dicamba. These treatment combinations were produced from reaction products with dicamba. A reaction buffer with dicamba was made by adding a solution of dicamba equal to 600 mg/L diluted from CLASH (Nufarm US) product. The dilution to achieve 100 ppm or 100 mg/L was made in 25 mM HEPES pH 7 in a 10 mL total volume. The ChD enzyme production was produced as previously described for the SM1 enzyme production. The ChD enzyme production was centrifuged to remove any cellular debris and then divided into aliquots of 100 μL containing the *Bacillus subtillis* (A64) filtrate with the ChD expressed enzyme. A volume of 100 μL of the ChD filtrate was added to the dicamba reaction buffer. The reactions were incubated at 37° C. with 400 ppm stirring for two hours. Aliquots of the reactions were collected and stored at −80° C.

Scores related to epinasty (Table 31) and damage to the trifoliate leaves (using scoring as described at the bottom of Table 31 are reported as the average score for 6 plants per each treatment (n=6). The results as indicated show no damage reported for epinasty or to the trifoliate leaves for the untreated control plants. The dicamba treatments alone showed an increased average epinasty score with increasing concentrations of dicamba from 100-200 ppm applied to the plants. The dicamba treatments applied at concentrations of 100 ppm, 150 ppm and 200 ppm were similar in the average trifoliate damage score with a score range of 3.5-3.6, which suggests that the 100 ppm concentration of dicamba was sufficient to cause damage where the youngest trifoliate leaves were almost dead or completely shriveled (approaching a damage score of 4). The ChD (SEQ ID NO: 169) enzyme when added with the different concentrations of dicamba did result in a decrease in damage as reported for both the epinasty score and for the damage score on the trifoliate leaves even at the highest concentration (200 ppm) of dicamba as compared to the any of the dicamba (applied alone) treatments. The addition of $MnSO_4$ with the ChD enzyme provided the greatest level of protection to the V1 soybean plants from dicamba damage provided at all three concentrations. The results as reported in Table 32 show that metal ions such as manganese ions provided as $MnSO_4$ decrease damage on soybean that results from a spray application with the dicamba herbicide.

TABLE 31

Soybean plants show protection from dicamba damage with the addition of metal ions applied in combination with chlorothalonil dehalogenase

| Treatment | Average Epinasty Score | Average Trifoliate Damage Score |
|---|---|---|
| Untreated Control | 0.0 | 0.0 |
| Dicamba (100 ppm) | 3.0 | 3.5 |
| Dicamba (100 ppm) + ChD | 1.5 | 3.2 |
| Dicamba (100 ppm) + ChD + 50 mM $MnSO_4$ | 0.3 | 1.7 |
| Dicamba (150 ppm) | 2.6 | 3.6 |
| Dicamba (150 ppm) + ChD | 1.0 | 2.4 |
| Dicamba (150 ppm) + ChD + 50 mM $MnO_4$ | 0.8 | 2.5 |
| Dicamba (200 ppm) | 3.2 | 3.6 |
| Dicamba (200 ppm) + ChD | 1.2 | 3.0 |
| Dicamba (200 ppm) + ChD + 50 mM $MnSO_4$ | 0.8 | 2.6 |

*A score of 0 indicates no damage/epinasty. Scores of 1, 2, and 3 indicate progressively increasing severe stem bending. A score of 4 indicates stem bending and leaf curling. Score 5 indicates the most severe degree of epinasty, resulting in death of the plant.

In another study to simulate damage that can occur to soybean plants from spray drift from a dicamba herbicide, soybean (variety Asgrow AG4034) was planted in a field (Mascoutah, Ill.) and grown as seedlings until the V3-V6 stage of development. The plants were then treated with dicamba (200 ppm) provided in combination with either the 6-chloronicotinic acid chlorohydrolase (CAC; SEQ ID NO: 167) or clorothalonil dehalogenase (ChD; SEQ ID NO: 169). The CAC and ChD enzymes were generated in production batches as previously described and divided up into aliquots and centrifuged to remove any cellular debris. A 100 µL volume of the *Bacillus subtilis* (A64) filtrate containing the ChD or the CAC expressed enzymes were added separately to the dicamba reaction buffer. The dicamba reaction buffer was made by adding a solution of dicamba equal to 600 mg/L diluted from CLASH (Nufarm US) product. The dilution to achieve 200 ppm or 200 mg/L was made in 25 mM HEPES pH 7 in a 10 mL total volume. Spray treatments for the plant protection assay included: an untreated control, the dicamba solution (200 ppm), the dicamba solution (200 ppm) with $MnSO_4$ (50 mM), dicamba (200 ppm) with either the CAC and ChD enzymes and dicamba (200 ppm) with either the CAC and ChD enzymes in combination with 50 mM $MnSO_4$ as described in Table 32. To each treatment, 0.01% SILWET L-77 surfactant was added. Then, 4 mL of reaction solution was applied evenly across 20 plants and compared to the untreated control plants applied to soybean grown in the same location in the field to minimize any field variability. After 11 days, the average trifoliate damage was evaluated by visual scoring. An average trifoliate damage score was calculated for the 20 plants per each treatment and reported in Table 32.

TABLE 32

Soybean plants show protection from dicamba damage with the addition of metal ions applied in combination with chlorothalonil dehalogenase in field grown soybeans

| Treatment | Average Trifoliate Damage Score |
|---|---|
| Untreated Control | 0.0 |
| Dicamba (200 ppm) | 2.5 |
| Dicamba (200 ppm) + 50 mM $MnSO_4$ | 3.0 |
| Dicamba (200 ppm) + CAC | 3.3 |
| Dicamba (200 ppm) + ChD | 2.3 |
| Dicamba (200 ppm) + CAC + 50 mM $MnSO_4$ | 1.0 |
| Dicamba (200 ppm) + ChD + 50 mM $MnSO_4$ | 1.1 |

The untreated control soybean plants showed no visible damage in the field. The dicamba reaction buffer containing 200 ppm resulted in an average trifoliate damage score of 2.5, which was increased to 3.0 with the addition of 50 mM $MnSO_4$. Addition of the ChD enzyme with dicamba (200 ppm) treatment did result in a decrease in damage to the trifoliate leaves of the soybean plants, while CAC did result in reduced damage. However, with the treatment combination that contained the dicamba reaction buffer (200 ppm) with either of the CAC or ChD enzymes and the manganese sulfate ($MnSO_4$) did result in a synergistically reduced damage to the trifoliate leaves. The average trifoliate damage score for the soybean plants was substantially lower resulting in a respective score of 1.0 and 1.1 compared to 2.5 for the dicamba alone treatment (Table 32).

Example 21

Use of dual enzymes 2,4-D alpha-ketoglutarate dioxygenase (TfdA) and 2,4-dichlorophenol hydroxylase (TfdB) to detoxify 2,4-D and the by-product 2,4-dichlorophenol TfdA Reaction Assay Methods Used to Quantify 2,4-dichlorophenol The herbicide detoxifying enzymes for 2,4-D and 2,4-dichlorophenol reactions are 2,4-D alpha-ketoglutarate dioxygenase (TfdA) and 2,4-dichlorophenol hydroxylase (TfdB). They were cloned, expressed, and produced in production batches as previously described for SM1 and other pesticide detoxifying enzymes. The amount of 2,4-D degradation by 2,4-D alpha-ketoglutarate dioxygenase (TfdA_198V; SEQ ID NO: 277) is a quantified by accumulation of the by-product produced by the reaction, 2,4-dichlorophenol. Degradation assays for 2,4-D were set up by allocating 10 µL of the TfdA enzyme in a reaction buffer containing: 10 mM imidazole (pH adjusted to 6.75), 1 mM α-ketoglutarate, 50 μM iron (II) sulfate, and 50 μM ascorbic acid (ascorbate). Per mL of reaction, 10 μL of enzyme production supernatant was added and an appropriate amount of 2,4-D containing product to raise 2,4-D concentration in the reaction to the desired concentration (generally 100 mg/L). The reactions to measure 2,4-D degradation were brought to a total volume of 5 mL. Reactions were then added to a 15 mL conical tube and placed in a shaker at 30° C. Aliquots consisting of 1 mL were taken from each reaction at the desired time points and flash frozen in a –80° C. freezer for later testing.

TfdA Colorimetric Assay Methods

The method to quantify the amount of degradation of 2,4-D by 2,4-D alpha-ketoglutarate dioxygenase (TfdA; SEQ ID NO: 281) is described herein. The 2,4-D degradation reaction samples were defrosted and vortexed. Samples consisting of 200 μL of each reaction were removed and placed in a 96 well plate. To each well on the assay plate containing a reaction sample, L borate buffer pH 10 (0.309 g boric acid, 0.373 g potassium chloride, 4.4 mL 1 M NaOH per 100 mL solution), 2 μL 2% 4-aminoantipyrine, and 2 μL 8% potassium ferricyanide were added. The wells were mixed by back pipetting. The plate was then covered with a film and placed in a 30° C. incubator for 1 hour. A volume of 200 μL was removed from each well and placed into a 96 well UV-Star® plate, (Greiner Bio-One) and read using a BioTek SYNERGY UV/VIS spectrophotometer (BioTek Industries, Inc.) set at a wavelength of 510 nm to detect the compound formed between 2,4-dichlorophenol (2,4-D and TfdA reaction product) and 4-aminoantipyrine.

The first and second steps of the reaction for 2,4-D alpha-ketoglutarate dioxygenase (TfdA (SEQ ID NO: 277)) and 2,4-dichlorophenol hydroxylase (TfdB (SEQ ID NO: 281)), both obtained from *Ralstonia eutropha* are shown below.

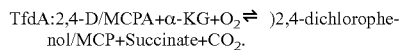

TfdA:2,4-D/MCPA+α-KG+O$_2$⇌ )2,4-dichlorophenol/MCP+Succinate+CO$_2$.

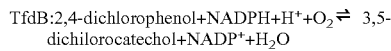

TfdB:2,4-dichlorophenol+NADPH+H$^+$+O$_2$⇌ 3,5-dichilorocatechol+NADP$^+$+H$_2$O Various substituted phenols such as 2,4-dichlorophenol can be readily converted to the corresponding catechol. Chlorophenol hydroxylase activity assays were performed as described in Ledger et. al. 2006 (Ledger, T. Pieper, D. H. and Gonzalez, 2006, "Chlorophenol hydrolases encoded by plasmid pJP4 differentially contribute to chlorophenoxyacetic acid degradation", Applied and Environmental Microbiology 72: pp. 2783-279). Activity of 2,4-dichlorophenol hydroxylase can be determined at 25° C. by a spectrophotometric assay. Each assay mixture contained 0.1 μmol aromatic substrates. Either NADH or NADPH can be used as a co-substrate to convert 2,4-dichlorophenol to the corresponding catechol. For TfdB activity, assay mixtures contained 50 mM Na$_2$HPO$_4$/KH$_2$PO$_4$ buffer (pH 7.6) and a volume of crude extract corresponding to 1 to 100 μg of protein (0.002 to 0.2 enzyme units). One unit of enzyme activity is the amount of crude extract that forms or consumes 1 μmol of product or substrate respectively, per min. Enzyme activity assays were performed in UV-STAR UV-transparent microplastes (Greiner Bio-One) and read outs were conducted using a BioTek SYNERGY UV/VIS spectrophotometer (BioTek Industries, Inc.). Activity of 2,4-dichlorophenol hydroxylase was measured by the consumption of NADH, as indicated by the decrease in absorbance at 340 nm ($\varepsilon_{340}$=6,300 M$^{-1}$ cm$^{-1}$). All assays were performed in the presence of 10 μM of FAD. Phenol-independent NADH oxidation was determined for each extract and this contribution was subtracted from the reported measurements. Each assay was initiated with the addition of 200 μM NADH to the reaction mixture. The accumulation of the chlorocatechol intermediate during the degradation of 2,4-dichlorophenol was determined by HPLC analysis.

Figure 19:
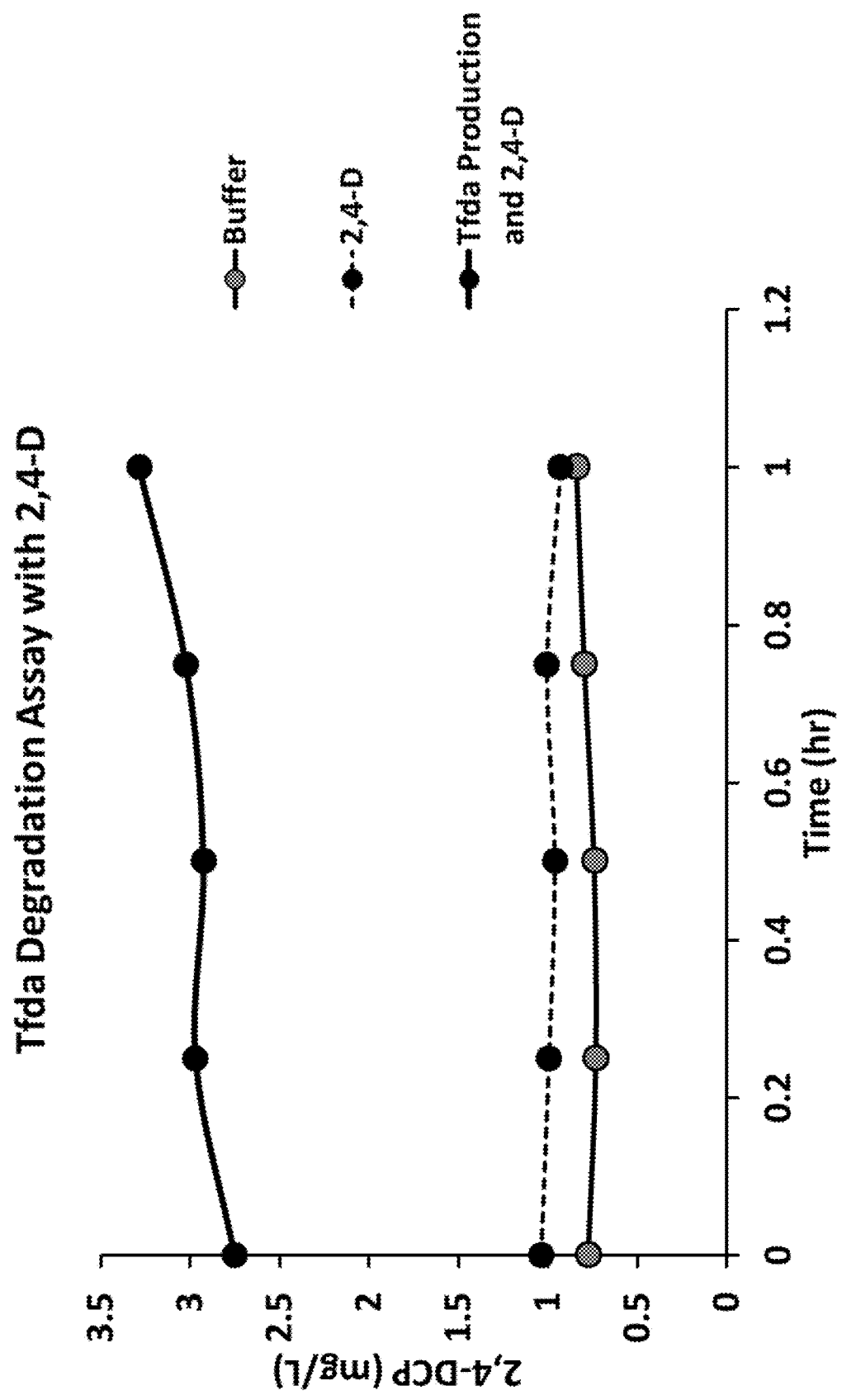
Figure 20:
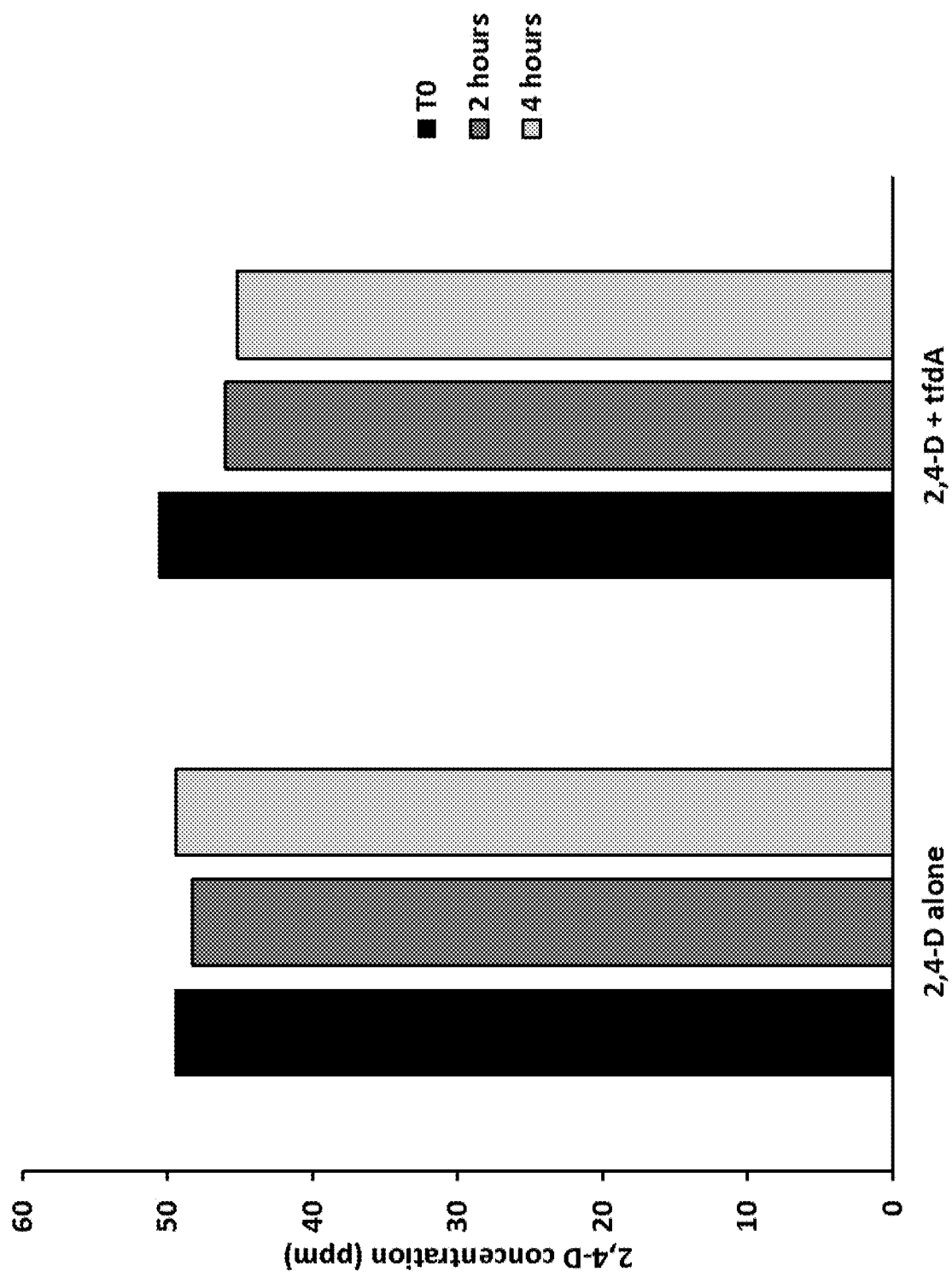

Addition of 2,4-D alpha-ketoglutarate dioxygenase (TfdA) was used in reaction mixtures to degrade 2,4-D and generate 2,4-dichlorophenol (2,4-DCP) or the breakdown product from this reaction. Comparisons of reaction mixtures with 2,4-D and the TfdA enzyme are shown with a time course and compared to a buffer alone and 2,4-D alone control samples in FIG. 19. Reactions using 2,4-D and TfdA reveal that TfdA is a functioning enzyme to degrade or breakdown 2,4-D into its component products (2,4-DCP). Reactions with 2,4-D and the active TfdA enzyme generated on average approximately over 2 mg/L of 2,4-dichlorophenol after 1 hour of incubation of the TfdA enzyme with 2,4-D. Additionally, when quantified by HPLC, we measured approximately a 10% reduction of 2,4-D concentration at 4 hours (FIG. 20).

Example 22

Ring Cleaving Dioxygenase for Acceleration of Dechlorination of Chlorophenoxy Herbicides A ring cleaving dioxygenase, MhqA (SEQ ID NO: 283) was cloned, expressed, and made in production batches as previously described for the pesticide detoxifying enzymes. The MhqA enzyme was specifically selected to act on chloroquinone compounds and chlorophenoxy herbicides as a direct donor of electrons for dechlorination reactions and functions in the degradation of aromatic compounds in the presence of iron (Fe$^{2+}$) as a cofactor (Table 7E).

Example 23

Co-factor Regeneration of NADH Using Sorbitol Dehydrogenase Enzyme

Figure 22:
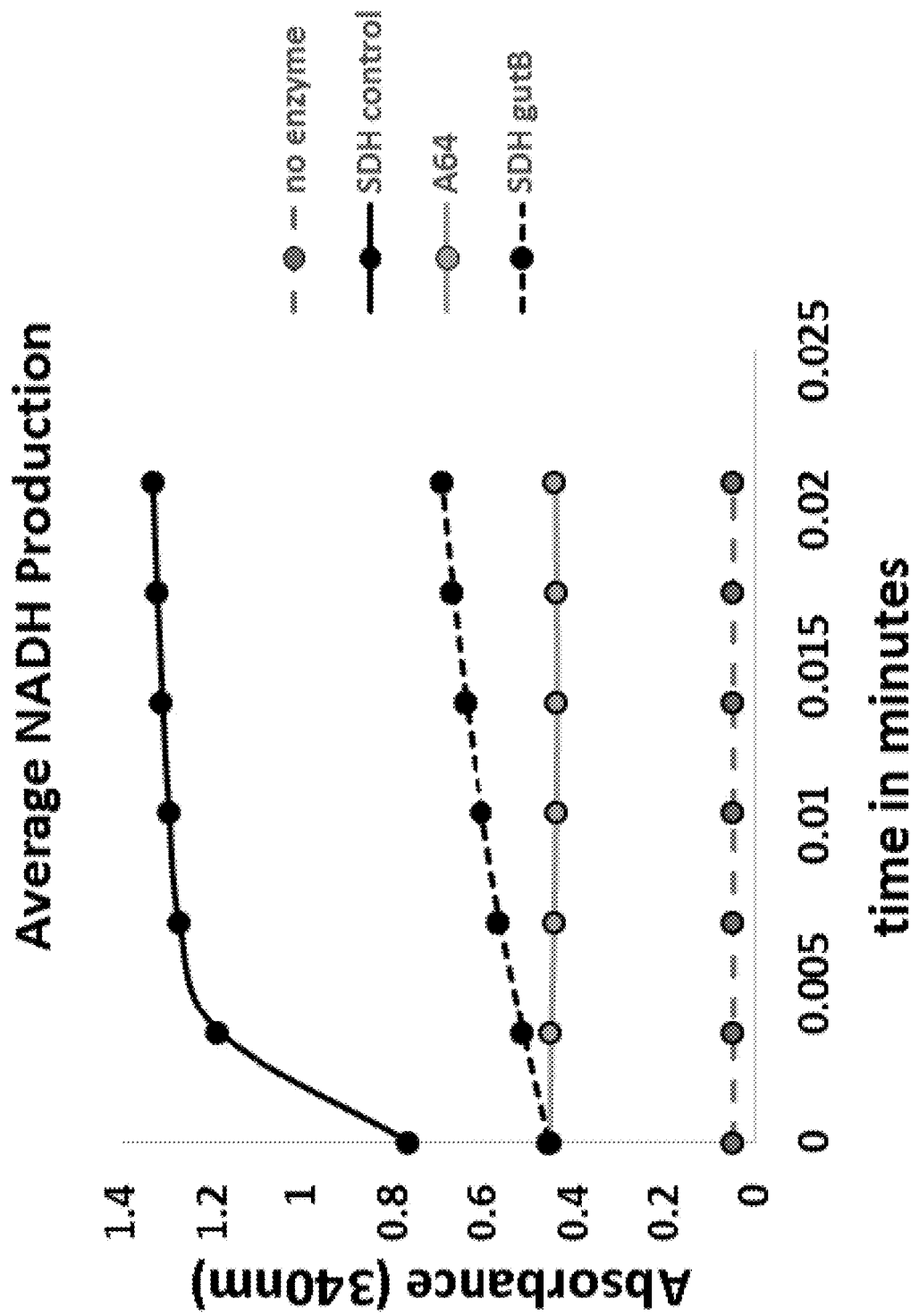

Sorbitol dehydrogenase (gutB; SEQ ID NO: 286) gene was selected for use as a regeneration enzyme to regenerate the cofactor NADH for use with specific herbicide detoxification enzymes that utilize NADH as a cofactor such as the monooxygenase enzymes as described in Tables 2 and 3B. The enzymatic reaction for sorbitol dehydrogenase is shown in FIG. 22 and below and the recycling reaction for NADH in a reaction with salicylate monooxygenase is described in below.

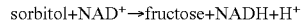

sorbitol+NAD$^+$→fructose+NADH+H$^+$

Cloning and Expression of Sorbitol Dehydrogenase (gutB)

The sorbitol dehydrogenase gene (gutB; SEQ ID NO: 286) was cloned from *Bacillus subtilis* 168 was done using similar methods as reported for the salicylate monooxygenase (SM1) enzyme. The expression plasmid pHT43-P69-gutB was cloned using In Fusion cloning reactions (In Fusion Cloning Kit, Takara) to generate accurate and directional cloning of gutB. Primers S779 and S901 were used to amplify the vector backbone. Specific primers for sorbitol dehydrogenase (gutB) S1171 and S1172 (Table 33) were then used to amplify the gutB gene sequence from A50 genomic DNA. PCR products were purified with the Wizard SV Gel and PCR Clean-up system (Promega Corporation) and digested with restriction enzyme DpnI for 1 hour at 37° C. The digested PCR products were purified again using the same Wizard SV Gel kit. Following the clean-up, 20 ng each of vector backbone and the gutB gene insert were combined with 1 μl of In Fusion Premix (Takara) solution in a 5 μl total reaction. The reactions were incubated at 50° C. for 15 min, and then chilled on ice. The entire reaction was transformed into Stellar *E. coli* competent cells (Takara) by heat shock at 42° C., recovery was then carried out at 37° C. in Luria-Bertani (LB) broth, and plating on LB-ampicillin agar plates. The plates were incubated at 37° C. overnight. Colonies with the correct gene insert sequences were identified by PCR and sequencing.

TABLE 33

Primers

| Primer | SEQ ID NO. for nucleotide sequence |
|---|---|
| S1171 pHT_gutB_F | 280 |
| S1172 pHT_gutB_R | 282 |

The pHT43-P69-gutB plasmid was then isolated from the *E. coli* cells with the Wizard SV Plus Minipreps DNA Purification System (Promega Corporation). A concentration of 300 ng of the pHT43-P69-gutB plasmid preparation was transformed into *Bacillus subtilis* A64 chemically competent cells plus 1 mM ethylene glycol-bis(β-aminoethyl ether-N,N,N',N'-tetraacetic acid (EGTA) using electroporation. The cells were incubated at 37° C. for 2 hours and then plated on agar plates containing N-chloramphenicol. Colonies with the correct insert sequence were identified with PCR and sequencing.

To express the GutB sorbitol dehydrogenase enzyme (SEQ ID NO: 288), the pHT43-P69-gutB plasmid containing the gene was streaked on an N-chloramphenicol plate. The next day, a single colony was used to inoculate a 5 mL N-chloramphenicol liquid culture, which was incubated at 37° C. overnight with 300 rpm shaking. The following day, this culture was used to start a 50 mL 2×YT-chloramphenicol liquid culture in a flask at OD 600=0.1. When the OD 600 reached 0.85, 0.1 mM isopropyl β-D-1-thiogalactopyranoside (IPTG; ranges of 0.1-1.0 mM can also be used) was added to the culture to induce the GutB sorbitol dehydrogenase expression. The culture was transferred to a 30° C. incubator with 300 rpm shaking for an overnight induction of enzyme expression. The following day, aliquots of the whole cell broth were transferred to tubes.

Measuring Sorbitol Dehydrogenase Enzyme Activity

To determine enzyme activity for sorbitol dehydrogenase in the production samples, reactions were set up with $NAD^+$, sorbitol and the sorbitol dehydrogenase enzyme collected in supernatant derived from the *Bacillus subtilis* A64 cultures. Absorbance at 340 nm was monitored with a BioTek SYNERGY HTX plate reader (BioTek Industries Inc.). In the assay, NADH exhibits an absorbance peak at 340 nm. The extinction coefficient of NADH at 340 nm (6220 $M^{-1}$ $cm^{-1}$) was used to estimate the enzyme activity of the sorbitol dehydrogenase enzyme. The enzyme activity was compared to commercially available sorbitol dehydrogenase enzyme produced from sheep liver (S-3764, Sigma-Aldrich). Based on absorbance readings at 5 min after the start of the reaction, GutB sorbitol dehydrogenase exhibited an activity level of 207 U/mL, which commercial sorbitol dehydrogenase from sheep liver (SDH control) was measured at 1447 U/mL.

NADH production was measured and reported as an average of 7 measurements and reported over a time series (0-36 min.) for the sorbitol dehydrogenase GutB (SDH GutB), the sorbitol dehydrogenase from sheep liver (SDH control) and compared to the A64 filtrate and no enzyme treatments both used as negative controls in the enzyme assay.

Figure 21:
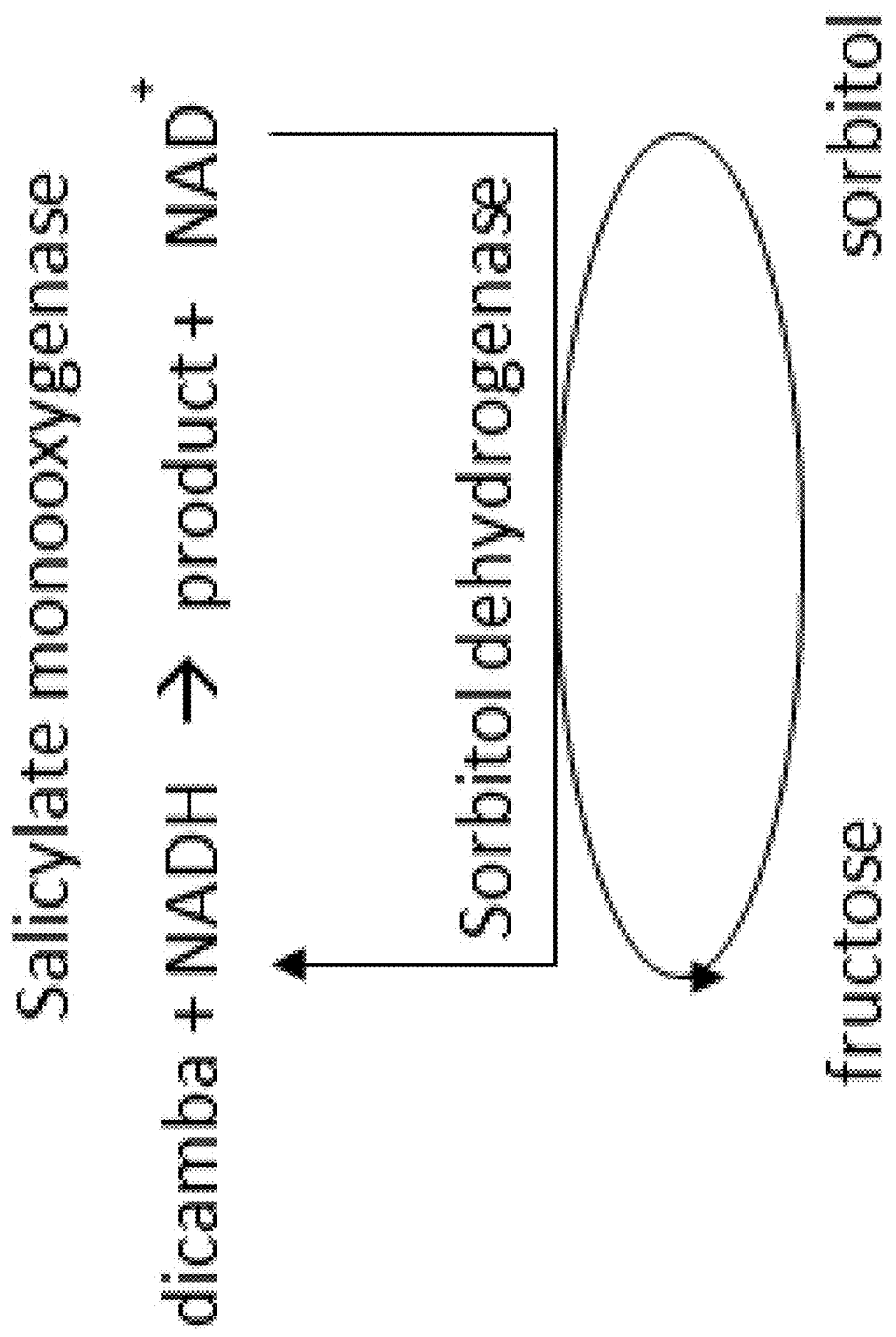

Sorbitol dehydrogenase (SDH GutB) as shown in FIG. 21 was used to regenerate NADH and was compared to the sorbitol dehydrogenase positive control from sheep liver (SDH control), which had greater regeneration of NADH in the reaction. However, the GutB sorbitol dehydrogenase (SDH GutB) enzyme resulted in sufficient ability to reduce NAD to NADH in the reaction when compared to no enzyme control reaction or to the background A64 from *B. subtilis* strain 168 that was used to generate SDH gutB (FIG. 21). The GutB sorbitol dehydrogenase used in a production filtrate or purified enzyme can be used with monooxygenase enzymes such as salicylate monooxygenase (SM1) enzyme that requires the NADH cofactor to increase reaction times for the degradation of the dicamba herbicide and sustain the activity and stability of the detoxifying enzyme.

In view of the above, it will be seen that the several objects of the invention are achieved and other advantageous results attained.

As various changes could be made in the above products and methods without departing from the scope of the invention, it is intended that all matter contained in the above description and shown in the accompanying figures shall be interpreted as illustrative and not in a limiting sense.

SEQUENCE LISTING (305 sequences)

SEQ ID NO: 1 - DNA, 1134 bp, Bacillus cereus
atgaataatgtcataattattggtggcggcattgctggtctatgtgcagcaatttccttacaaaaaataggattagatgtaaaagtatatgacaaaaatactgaacctactgttgctggtgcaggtattatcattgccccaaacgcaatgcaagcacttgaactatacggcatttctaagaaaatcaaaaaattcggcaacgaaagtgacggttttaaccttgtatccgaaaaaggtactactttcaataagttaattattccaacttgctatccaaaaatgtactccattcatagaaaagatttacaccaattactactttctgaactaaaagaagatactgtcaagtggggaaaagaatgcgtaaaaatagaacagaatgaagcaaacgccttaaaaatagtatttcaagatggtagtgaagcactcggtaatatactcattgcggctgatggtattcattctgtcattcgaaaacaagtaacacaaggcgataattatcgttatgcaggatatacgtgttggcgcggcgtaactcctgctaataatctttctttaacaaatgattttattgaaacttggggaacaaacggtagatttggtatcgtccctcttcctaacaacgaagtatactggtatgcgctaataaatgctaaagctagagatccaaaatacaaagcttacacaacaacagatttatataatcatttcaaaacttaccacaatccaatcccatctattttaaagaacgcatcggacattgatatgattcatcgtgatattatagacattacgccaatgaaacagttttttgacaaacgcatcgtattcattggggatgctgcccatgcacttactccgaatttaggccaaggtgcttgccaagcaattgaagatgcgattattctggctgaatgcattaaaaataatgctcattatcgtcaagcatttttagaatacgaacaaaaacgacgagatagaattgaaaaaatctcaaacactgcatggaaagttggaaaaatggcacaaatagaaagtaaacctttaactctagtaagaaacgaagtaatgaaacgtatgccaaaatgggtttctgaaaagcgaacacatgaactatatagttttcatttataa

SEQ ID NO: 2 - DNA, 1134 bp, Bacillus thuringiensis
atgaataatgtcataattattggtggcggcattgctggtctatgtgcagcaatttccttacaaaaaataggattagatgtaaaagtatatgacaaaaatactgaacctactgttgctggtgcgggtattatcattgccccaaacgcaatgcaagcacttgaactatacggcatttctaagaaaatcaaaaaattcggcaacgaaagtgacggttttaaccttgtatccgaaaaaggtactactttcaataagttaattattccaacttgctatccaaaaatgtactccattcatagaaaagatttacaccaattactactttctgaactaaaagaagatactgtcaagtggggaaaagaatgcgtaaaaatagaacagaatgaagcaaacgccttaaaaatagtatttcaagatggtagtgaagcactcggtaatatactcattgcggctgatggtattcattctgtcattcgaaaacaagtaacacaaggcgataattatcgttatgcaggatatacgtgttggcgcggcgtaactcctgctaataatctttctttaacaaatgattttattgaaacttggggaacaaacggtagatttggtatcgtccctcttcctaacaacgaagtatactggtatgcgctaataaatgctaaagctagagatccaaaatacaaagcttacacaacaacagatttatataatcatttcaaaacttaccacaatccaatcccatctattttacaaaacgcatcggacattgatatgattcatcgtgatattatagacatcactccaatgaaacagttttttgacaaacgcatcgtattcattggggatgctgcccatgcacttactccgaatttaggccaaggtgcttgccaagcaattgaagatgcgattattctggctgaatgcattaaaaataatgctcattatcgtcaagcatttttagaatacgaacaaaaacgacgagatagaattgaaaaaatctcaaatactgcatggaaagttggaaaaatggcacaaatagaaagtaaacctttaactctagtaagaaacgaagtaatgaaacgtatgccaaaatgggtttctgaaaagcgaacacatgaactatatagttttcatttataa

SEQ ID NO: 3 - DNA, 1134 bp, Bacillus cereus
atgaataatgtcataattattggtggcggcattgctggtctatgtgcagcaatttccttacaaaaaataggattagatgtaaaagtatatgacaaaaatactgaacctactgttgctggtgcgggtattatcattgccccaaacgcaatgcaagcacttgaactatacggcatttctaagaaaatcaaaaaattcggcaacgaaagtgacggttttaaccttgtatccgaaaaaggtactactttcaataagttaattattccaacttgctatccaaaaatgtactccattcatagaaaagatttacaccaattactactttctgaactaaaagaagatactgtcaagtgggggaaagaatgcgtaaaaatagaacaaaatgaagcaaacgccttaaaaatagtatttcaagatggtagtgaagcactcggtaatatactcattgcggctgatggtattcattctgtcattcgaaaacaagtaacacaaggcgataattatcgttatgcaggatatacgtgttggcgcggcgtaactcctgctaataatctttctttaacaaatgattttattgaaacttggggaacaaacggtagatttggtatcgtccctcttcctaacaacgaagtatactggtatgcgctaataaatgctaaagctagagatccaaaatacaaagcttacacaacaacagatttatataatcatttcaaaacttaccataatccaatcccatctattttacaaaacgcatcggatgttgatatgattcatcgtgatattatagacattacgccaatgaaacagttttttgacaaacgcatcgtattcattggggatgctgcccatgcacttactccgaatttaggccaaggtgcttgccaagcaattgaagatgcgattattctggctgaatgcattaaaaataatgctcattatcgtcaagcatttttagaatacgaacaaaaacgacgagatagaattgaaaaaatctcaaatactgcatggaaagttggaaaaatggcacaaatagaaagtaaacctttaactctagtaagaaacgaagtaatgaaacgtatgccaaaatgggtttctgaaaagcgaacacatgaactatatagttttcatttataa

SEQ ID NO: 4 - DNA, 1134 bp, Bacillus cereus
atgaataatgtcataattattggtggcggcattgctggtctatgtgcagcaatttccttacaaaaaataggattagatgtaaaagtatatgacaaaaatactgaacctactgttgctggtgcgggtattatcattgccccaaacgcaatgcaagcacttgaactatacggcatttctaagaaaatcaaaaaattcggcaacgaaagtaacggttttaaccttgtatccgaaaaaggtactactttcaataagttaattattccaacttgctatccaaaaatgtactccattcatagaaaagatttacaccaattactactttctgaactaaaagaagatactgtcaagtggggaaaagaatgcgtaaaaatagaacagaatgaagcaaacgccttaaaaatagtatttcaagatggtagtgaagcactcggtaatatactcattgcggctgatggtattcattctgtcattcgaaaacaagtaacacaaggcgataattatcgttatgcaggatatacgtgttggcgcggcgtaactcctgctaataatctttctttaacaaatgattttattgaaacttggggaacaaacggtagatttggtatcgtccctcttcctaacaacgaagtatactggtatgcgctaataaatgctaaagctagagatccaaaatacaaagcttacacaacaacagatttatataatcatttcaaaacttaccacaatccaatcccatctattttaaagaacgcatcggacattgatatgattcatcgtgatattatagacatcactccaatgaaacagttttttgacaaacgcatcgtattcattggggatgctgcccatgcacttactccgaatttaggccaaggtgcttgccaagcaattgaagatgcgattattctggctgaatgcattaaaaataatgctcattatcgtcaagcatttttagaatacgaacaaaaacgacgagatagaattgaaaaaatctcaaatactgcatggaaagttggaaaaatggcacaaatagaaaataaacctttaactctagtaagaaacgaagtaatgaaacgtatgccaaaatgggtttctgaaaagcgaacacatgaactatatagttttcatttataa

SEQ ID NO: 5 - DNA, 1134 bp, Bacillus thuringiensis
atgaataatgtcataattattggtggcggcattgctggtctatgtgcagcaatttccttacaaaaaataggattagatgtaaaagtatatgacaaaaatactgaacctactgttgctggtgcgggtattatcattgccccaaacgcaatgcaagcacttgaactatacggcatttctaagaaaatcaaaaaattcggcaacgaaagtgacggttttaaccttgtatccgaaaaaggtactactttcaataagttaattattccaacttgctatccaaaaatgtactccattcatagaaaagatttacaccaattactactttctgaactaaaagaacatactgtcaagtggggaaaagaatgcgtaaaaatagaacagaatgaagcaaacgccttaaaaatagtatttcaagatggtagtcaagcactcggtaatatactcattgcggctgatggtattcattctgtcattcgaaaacaagtaacacaaggcgataattatcgttatgcaggatatacgtgttggcgcggcgtaactcctgctaataatctttctttaacaaatgattttattgaaacttggggaacaaacggtagatttggtatcgtccctcttcctaacaacgaagtatactggtatgcgctaataaatgctaaagctagagatccaaaatacaaagcttacacaacaacagatttatataatcatttcaaaacttaccacaatccaatcccatctattttaaagaacgcatcggacattgatatgattcatcgtgatattatagacattacgccaatgaaacagttttttgacaaacgcattgtattcattggggatgctgcccatgcacttactccgaatttaggccaaggtgcttgccaagcaattgaagatgcgattattctggctgaatgcattaaaaataatgctcattatcgtcaagcatttttagaatacgaacaaaaacgacgagatagaattgaaaaaatctcaaacactgcatggaaagttggaaaaatggcacaaatagaaagtaaacctttaactctagtaagaaacgaagtaatgaaacgtatgccaaaatgggtttctgaaaagcgaacacatgaactatatagttttcatttataa

SEQ ID NO: 6 - DNA, 1134 bp, Bacillus cereus
atgaacaatgtcataattattggtggcggtattgctggactttgcgcagcaatttccttacaaaaaataggaatagaagtaaaagtatatgataaaaacaatgagcctactgttgctggtgcaggtattatcattgccccaaacgcaatgcaagcacttgaactatacggcatttctaagaaaatcaaaaaattcggcaacgaaagtgacggttttaaccttgtatccgaaaaaggtactactttcaataagttaattattccaacttgctatccaaaaatgtactccattcatagaaaagatttacaccaattactactttctgaactaaaagaagatactgtcaagtggggaaaagaatgcgtaaaaatagaacagaatgaagcaagcgccttaaagatagtatttcaagatggtagtgaagcactcggtaatatactcattgcggctgatggtattcattctgtcattcgaaagcaagtaacacaaggcgataattatcgttatgcaggatatacgtgttggcgcggcgtaactcctgctaataatctttctttaacaaatgattttattgaaacttggggaacaaacggtagatttggtatcgtccctcttcctaacaacgaagtatactggtatgcgctcataaacgcgaaagctagagatcaaaaatacaaagcttacacaacaacagatttatataatcatttcaaaacttaccataatccaatcccatctattttaaagaacgcatcggacattgatatgattcatcgtgatattatagacatcactccaatgaaacagttttttgacaaacgcatcgtattcattggggatgctgcccatgcacttactccgaatttaggccaaggtgcttgccaagcaattgaagatgcgattattctggctgaatgcattaaaaataatgctcattatcgtcaagcatttttagaatacgaacaaaaacgacgagatagaattgaaaaaatctcaaatactgcatggaaagttggaaaaatggcacaaatagaaagtaaacctttaactatagtaagaaacgaagtaatgaaacgtatgccaaaatgggtttctgaaaagcaaacacatgaactatatagttttcatttataa

SEQ ID NO: 7 - DNA, 1134 bp, Bacillus cereus
atgaacaatgtcataattattggtggcggtattgctggactttgcgcagcaatttccttacaaaaaataggaatagaagtaaaagtatatgataaaaacaatgagcctactgttgctggtgcaggtattatcattgccccaaacgcaatgcaagcacttgaactatacggcatttctaagaaaatcaaaaaattcggcaacgaaagtgacggttttaaccttgtatccgaaaaaggtactactttcaataagttaattattccaacttgctatccaaaaatgtactccattcatagaaaagatttacaccaattactactttgtgaactaaaagaagatactgtcaagtggggaaaagaatgcgtaaaaatagaacagaatgaagcaagcgccttaaagatagtatttcaagatggtagtgaagcactcggtaatatactcattgcggctgatggtattcattctgtcattcgaaagcaagtaacacaaggcgataattatcgttatgcaggatatacgtgttggcgcggcgtaactcctgctaataatctttctttaacaaatgattttattgaaacttggggaacaaacggtagatttggtatcgtccctcttcctaacaacgaagtatactggtatgcgctcataaacacgaaagctagagatcaaaaatacaaagcttacacaacaacagatttatataatcatttcaaaacttaccataatccaatcccatctattttaaagaacgcatcggacattgatatgattcatcgtgatattatagacatcactccaatgaaacagttttttgacaaacgcatcgtattcattggggatgctgcccatgcacttactccgaatttaggccaaggtgcttgccaagcaattgaagatgcgattattctggctgaatgcattaaaaataatgcccattatcgtcaagcatttatagaatacgaacaaaaaagacgggatagaattgaaaaaatctcaaacactgcgtggacagttggaaaaatggcgcaaatagaaagtaaacctttaactatagtaagaaatgaagtaatgaaacgtattccaaaatggatttctgaaaggcaagcacatgaactatacaactttcatttataa

SEQ ID NO: 8 - DNA, 1134 bp, Bacillus cereus
atgaataatgtcataattattggtggcggcattgctggtctatgtgcagcaatttccttacaaaaaataggattagatgtaaaagtatatgacaaaaatactgaacctactgttgctggtgcaggtattatcattgccccaaacgcaatgcaagcacttgaactatacggcatttctaagaaaatcaaaaaattcggcaacgaaagtgacggttttaaccttgtatccgaaaaaggtactactttcaataagttaattattccaacttgctatccaaaaatgtactccattcatagaaaagatttacaccaattactactttctgaactaaaagaagatactgtcaagtggggaaaagaatgtgtaaaaatagaacaaaatgaagaaaacgccttaaaaatagtattccaagatggtagtgaagcacttggcaatatactcattgcggctgatggtattcattctatcgttcgaaaacaagtaacacaaggcgataattatcgttatgcaggatatacgtgttggcgcggcgtaacccctactaagaatctttctttaacaaatgattttattgaaacttggggaacaaacggtagatttggtatcgtccctcttcctaacaacgaagtatactggtatgcgctcataaatgctaaagctagagatccaaaatacaaagcttacacaacaacagatttatataatcatttcaaaacttaccataatccaatcccatctattttacaaaacgcatcggatgttgatatgattcatcgtgatattatagacattactccaatgaaacagttttttgacaaacgcatcgtattcattggggatgctgcccatgcacttactccgaatttaggccaaggtgcttgtcaagcaattgaagatgcgattattctggctgaatgtatcaaaaataatgcttattatcgtcaagcatttacagaatttgaacaaaaacgacgagatagaattgaaaaaatctcaaacactgcatggaaagttggaaaagtggcgcaaatagaaagtaaacctttaactatagtaagaaataaagtaatgaaacgtattccaaaatggatttctgaaaggcaagcacatgaactttacaagtttcatttataa

SEQ ID NO: 9 - DNA, 1134 bp, Bacillus thuringiensis
atgaataatgtcataattattggtggcggcattgctggtctatgtgcagcaatttccttacaaaaaataggattagatgtaaaagtatatgacaaaaatactgaacctactgttgctggtgcaggtattatcattgccccaaacgcaatgcaagcacttgaactatacggcatttctaagaaaatcaaaaaattcggcaacgaaagtgacggttttaaccttgtatccaaaaaaggtactactttcaataagttaattattccaacttgctatcccaaaatgtactccattcatagaaaagatttacaccaattactactttctgaactaaaagaagatactgtcaagtggggaaaagaatgtgtaaaaatagaacaaaatgaagaaaacgccttaaaaatagtattccaagatggtagtgaagcacttggcaatatactcattgcggctgatggtattcattctatcgttcgaaaacaagtaacacaaggcgataattatcgttatgcaggatatacgtgttggcgcggcgtaactcctactaagaatctttctttaacaaatgattttattgaaacttggggaacaaacggtagatttggtatcgtccctcttcctaacaacgaagtatactggtatgcgctcataaatgctaaagctagagatccaaaatacaaagcttacacaacaacagatttatataatcatttcaaaacttaccacaatccaatcccatctattttacaaaacgcatcggacattgatatgattcatcgtgatattatagacatcactccaatgaaacagttttttgacaaacgcatcgtatttattggggatgctgcccatgcacttactccaaatttaggtcaaggtgcttgtcaagcaattgaagatgcgattattctggctgaatgtatcaaaaataatgcttattatcgtcaagcatttacagaatttgaacaaaaacgacgagatagaattgaaaaaatctcaaacactgcatggaaagttggaaaaatagcgcaaatagaaagtaaacctttaactatagtaagaaataaagtaatgaaacgtattccaaaatggatttctgaaaggcaagcacatgaactttacaggtttcatttataa

SEQ ID NO: 10 - DNA, 1473 bp, Bacillus cereus
atggcaattagaacaggggaacagtatattgaagggttgcgaaaaagaaatcctgaaatttggattggaggaagaaaagtaacggatgtagtaaatgaagatgtttttcgtgaaccaattatacaaattgcgaacttatatgatatgcagcacaatccagaatatcaagataagattactcatatatgcgaagagacaggagaaagggtatcaaatgcatttttagtaccgagaaattatgaggatttaaaagtacgccgcgaattatttgaagtgtgggcaaaagccacttatggtttaatgggtagaacacctgattttttaaatgtaacggttacttcaatggcaagtaattcgtggttttttgagaagtttaatccagaatggggagcgaatataaaaaattattataaacatataagggataatgatttgtttttaacacacgcaattattaatccgcaaaatgatcggagtaaggcctcccatcaacaagaagatgaaacaatgcatttaggggtagtaagtgaaacagcggaaggaatgtatgttagtggtgctaaaatgttagcgacactggcgccgattacggatgaggtaataatatattcctatccaagttttaagccaggtgatgaacgtcatgcaatttcttttgcagttccaattgacgcaccaggtctaagaattctatgtcgtgagccaatgcaagatggaaaacgatctttatttgatcacccacttgcatcaaggtttgaggaaatggatgcattactagtatttcataatgtgtttatcccgtgggataaagtatttatttatcaaagtgtggaagctgggaatcaattgtatcctaaaaccggaattggtcatcaaccagcacatcaatctggggtaagagggttagtaaaactatcttttgcagctgaagtagctatgaaattagcagattcgattggagtagatggttttttaaatgtacaaaaccagttagcagagcttatgcaagatgtcgaaacgatacgtgctctcctgcaagtagctgaatatgagtatgaaacgaattcatatggagaagttattcctgcgaggttaccgcttgatacgatacgcagtttattacctaagatgtatccgcgggctattgagattattcaaactataggtgcgggtggattattaatgtcaccgacaggtgctgattttatgaaccccgagattcatgatgatatgcaaaagtattatatcgggcgtgaaggagtatcctctgaggaacgggttcgtttgtttaaattagcatgggacttatgtggtgaggcttttggacaacggttattacaatatgagcgttattattctggagatccggtgcgtaaaatgggaatgttttataatgcgtacaaaaaacaacaaactttttcacttgtgaacaatgcgttgcaatcgagttcatctgaaggggccttaagttaa

SEQ ID NO: 11 - DNA, 1473 bp, Bacillus cereus
atggcaattagaacaggggaacagtatattgaaggattgagaaaaagaaatcctgaaatttggattggaggaagaaaagtaacggatgtagtaaatgaagatgtttttcgtgaaccaattatacaaattgcgaacttatatgatatgcagcacaatccagaatatcaagataagattactcatatatgcgaagagacaggagaaagggtatcaaatgcatttttagtaccgaaaaattatgaagatttaaaagtacgccgtgaattatttgaagtgtgggcaaaagctacttatggtttaatgggtagaacacctgattttttaaatgtaacggttacttcgatggcaagtaattcgtggttttttgagaagtttaatccagaatggggagcgaatataaaaaattattataaacatataagggataatgatttgtttttaacacacgcaattattaatccgcaaaatgatcggagtaaggcatctcatcaacaagaagatgaaactatgcatttaggggtagtaagtgaaacagcggaagggatgtatgttagtggtgctaaaatgttagcgacactggcgccgattacggatgagttaataatatattcctatccaagctttaaaccaggtgatgaacgtcatgcaatttcttttgcagttccaattgatgcaccaggtctaagaattttatgtcgtgagccaatgcaagatggaaaacgatctttatttgatcatccacttgcatcaaggtttgaggaaatggacgcattactagtatttcataatgtgtttatcccgtgggataaagtatttatttatcaaagtgtggaagctgggaatcaattgtatcctaaaaccggaattggtcatcaaccagcccatcaatctggagtaagagggttagtaaaactatcttttgcagctgaagtagctatgaaattagcagattcgattggcgtagatggatttttaaatgtacaaaaccagttagcagagcttatgcaagatgtcgaaacgatacgcgctctcctgcaagtagctgaatatgagtatgaaacgaattcatatggagaagttattcctgcgaggttgccgcttgatacgatccgcagtttattacctaaaatgtatccgcgggctattgagattattcaaactataggtgctggtggattattaatgtcaccgacaggtgctgattttatgaatcctgagattcatgatgatatgcaaaagtattatatcgggcgtgaaggagtatcctctgaggaacgggttcgtttgtttaaattagcatgggacttatgtggtgaggcttttggacaacgattattacaatatgagcgttattattctggagatccagtgcgtaaaatgggaatgttttataatgcgtacaaaaaacaacaaactttttcacttgtgaacaatgcgttgcaatcgagttcatctgaaggggccttaagttga

SEQ ID NO: 12 - DNA, 1473 bp, Bacillus cereus
atggcaattagaacaggggaacagtatattgaaggattgagaaaaagaaatcctgaaatttggattggaggaagaaaagtaacggatgtagtaaatgaagatgtttttcgtgaaccaattttacaaattgcgaacttatatgatatgcagcacaatccagaatatcaagataagattactcatatatgcgaagagacaggagaaagggtatcaaatgcatttttagtaccgaaaaattatgaggatttaaaagtacgccgtgaattatttgaagtgtgggcaaaagctacttatggtttaatgggtagaacacctgattttttaaatgtaacggttacttcgatggcaagtaattcgtggttttttgagaagtttaatccagaatggggagcgaatataaaaaattattataaacatataagggataatgatttgtttttaacacacgcaattattaatccacaaaatgatcggagtaaggcttcccatcaacaagaagatgaaacaatgcatttaggggtagtaagtgaagcagcggaagggatgtatgttagtggtgctaaaatgttagcgacactggcgccgattacggatgaggtaataatatattcctatccaagctttaagccaggtgatgaacgtcatgcaatttcttttgcagttccaattgacgcaccaggtctaagaattctatgtcgtgagccaatgcaagatggaaaacgatctttatttgatcacccacttgcatcaagatttgaggaaatggatgcattactagtatttcataatgtgtttatcccgtgggataaagtatttatttatcaaagtgtggaagctgggaatcaattgtatcctaaaaccggaattggtcatcaaccagcccatcaatctggggtaagagggttagtaaaactatcttttgcagctgaagtagctatgaaattagcagattcgattggagtagatggatttttaaatgtacaaaaccagttagcagagcttatgcaagatgttgaaacgatacgcgctctcctgcaagtagctgaatatgagtatgaaacgaattcatatggagaagttattcctgcgaggttgccgcttgatacgatacgcagtttattacctaagatgtacccgcgtgctattgagattattcaaacaataggtgctggtggattattaatgtcaccgacaggtgctgattttatgaaccccgagattcaagatgatatgcaaaaatattatatcgggcgtgaaggagtatcttctgaggaacgggttcgtttatttaaattagcatgggacttatgtggtgaggcttttggacaacggttattacaatatgagcgttattattctggagatccggtgcgtaaaatgggaatgttttataatgcgtacaaaaaacaacaaactttttcacttgtgaacaatgcattgcaatcgagttcatctgaaggagccttaagttaa

SEQ ID NO: 13 - DNA, 1473 bp, Bacillus cereus
atggcaattagaacaggggaacagtatattgaagggttgcgaaaaagaaatcctgaaatttggattggtggaagaaaagtaacggatgtagtaaatgaagatgtttttcgtgaaccaattttacaaattgcgaacttatatgatatgcagcacaatccagaatatcaagataagattactcatatatgcgaagagacaggggaaagggtatcaaatgcatttttagtaccgaaaaattatgaggatttaaaagtacgccgtgaattatttgaagtgtgggcaaaagctacttatggtttaatgggtagaacacctgattttttaaatgtaacggttacttcgatggcaagtaattcgtggttttttgagaagttcaatccagaatggggagcgaatataaaaaattattataaacatataagggataatgatttgtttttaacacacgcaattattaatccgcaaaatgatcggagtaaggcttctcatcaacaagaagatgaaacgatgcatttaggggtagtaagtgaaacagcagaagggatgtatgttagtggtgctaaaatgttagcgacactcgctcctattacagacgaggtaattatatattcctatccaagttttaagccaggtgatgaacgtcatgcaatctcttttgcagtaccaattgatgcaccaggactaagaattctttgtcgtgagccaatgcaagatggaaaacgttctctatttgatcatccacttgcatcaaggtttgaggagatggatgcattactagtatttcataatgtgtttatcccgtgggataaagtatttatttatcaaaatatagaagctgggaatcaattgtatcctaaaacgggaattggtcatcaaccagcgcatcaatctggggtaagaggattagttaagctttctttcgctgctgaagtagctatgaaattagcagattcgataggagtagatggatttttaaatgtacaaaaccagttagcagagcttatgcaagatgtcgaaacgatacgagctctcttacaagtagctgaatatgaatatgaaacgaatccatatggagaagttgttcctgcaaggttgccacttgatacaatacgcagtttattacctaaaatgtatccacgtgcaattgagattattcaaaccattggtgctggtggattattaatgtcaccgacaggtgcagattttatgaatcccgaaattcaagacgatatggaaaaatactatatcgggcgtgaaggagtatcttctgaggaacgagttcgtttatttaaattagcatgggatttatgtggagaagcttttggacaacggttattacaatatgagcgttattattctggagatccggtgcgtaaaatgggaatgttttataatgcgtacaaaaaacaacaaacgttttctctagtgaacaatgcgttgcaatcaagttcatctgaaggtgctttaagttaa

SEQ ID NO: 14 - DNA, 1473 bp, Bacillus cereus
atgggcattagaacaggggaacagtatattgaaggattgcgaaaaagaaatcctgaaatttggattggcgggagaaaagtaacggatgtagtaaatgaagatatttttcgtgaacccattttacaaattgcgaacttatatgatatgcaacaccatccagaatatcaagataaaattactcatatatgcgaagagacaggggaaagagtatcaaatgcatttttagttcctaaaaattatgaggacttaaaggcacgccgtgaattatttgaagtatgggcaaaagctacttttggtttaatgggtagaacacctgattttttaaatgtaacggttacctcgatggcaagtaattcgtggttttttgagaagtttaattcagaatggggagcgaatataaaaaattactataaacatataagggataatgatttgtttttaacacatgcaattattaatccacaaaatgatcggagtaaggcttctcatcaacaagaagatgaaacaatgcatttaggggtagtaagtgaaacagcggaagggatgtatgtgagtggtgctaaaatgttagcgacactggcgccgattacggatgaggtaattatatattcatatccgagttttaaaccaggtgatgaacgtcatgcgatctcttttgcagttccgattgatgccccaggactcaggattctatgtcgtgagccaatgcaagatggaaaacgttctttatttgatcatccacttgcatcaaggtttgaggaaatggatgcattactagtatttcataatgtgtttatcccgtgggataaagtatttatttatcaaagtgtagaagctggtaatcaattgtatcctaaaacaggaattggtcatcaaccagcgcatcaatctggagtaagaggattagtaaaactatcattcgctgctgaagtagctatgaaagtagcagattcgataggagtagatgggtttttaaatgtacaaaatcagttagcagagctgatgcaagatgtcgaaacgatacgtgcactcctgcaagtagctgaatatgagtatgaaacaaattcatatggagaagttattcctgcgaggctaccgcttgatacgattcgtagtttattaccaaagatgtatccacgtgctattgagattattcaaaccattggtgctggtggattattaatgtcaccaacaggtgcggattttatgacccccgagattcaagatgatatgcaaaagtattatatcgggcgtgaaggcgtatcctctgaggaacgagttcgcttgtttaaattagcgtgggatttatgcggtgaagcttttgggcaacgattattacaatatgagcgttattattctggagatccggtgcgtaaaatgggaatgttttataatgcgtataaaaaacaacaaactttttcgcttgtgaacaatgcgttgcaatcgagttcatctgaaggagccttaagttaa

SEQ ID NO: 15 - DNA, 1473 bp, Bacillus cereus
atggcaattagaacaggggaacagtatattgaagggttgcgaaaaagaaatcctgaaatttggattggtggaagaaaagtaacggatgtagtaaatgaagatgtttttcgcgaacctattttacaaattgctaacttatatgatatgcagcacaatccagaatatcaggataagattactcatatatgcgaagagacaggcgaaagggtatcaaatgcatttttagtgcccaaaaattatgaggacttaaaagcacgtcgtgaattatttgaagtgtgggcaaaagctacgtttggtttaatgggaagaacacctgactttttaaatgtaacagttacttcaatggcaagtaattcgtggttttttgagaagttcgattcagaatggggagcgaatataaaaaattattataaacatatacgggataatgatttgtttttaacacatgcgattattaatccgcaaaatgatcggagtaaggcttctcatcaacaagaagatgaaacgatgcatttaggtgtagtaagtgaaacagcggaaggaatgtatgtaagtggtgcaaaaatgttagcgacgcttgctccaattacagacgaggtaattatatattcctatccaagttttaaaccaggtgatgaacgtcatgccatctcttttgcagttccaattgatgcaccaggattaagaattctttgtcgtgagccaatgcaagatggaaaacgctctctatttgatcatccacttgcatcaaggtttgaggagatggatgcattactagtatttcataatgtgtttatcccgtgggataaagtatttatttatcaaaatatagaagctgggaatcaattgtatcctaaaacgggaattggtcatcaaccagcgcatcaatctggggtaagaggattagttaagctttctttcgctgctgaagtagctatgaaattagcagattcgataggagtagatggatttttaaatgtacaaaaccagttagcagagcttatgcaagatgtcgaaacgatacgagctctcttacaagtagctgaatatgaatatgaaacgaatccatatggagaagttgttcctgcaaggttgccacttgatacgatacgcagtttattacctaaaatgtatccgcgtgcaattgagattattcaaaccattggtgctggtggattattaatgtcaccgacaggtgcagatttcatgaatcccgaaattcaagacgatatggaaaaatactatattgggcgtgaaggagtatcttctgaagaacgagttcgtttatttaaattagcatgggatttatgtggagaggcttttggacaacgattattacaatatgagcgctattattctggagatccggtgcgcaaaatgggaatgttttataatgcgtacaaaaagcaacaaacgttttctctagtgaacaatgcgttgcaatcgagttcatcagaaggtgctttaagctaa

SEQ ID NO: 16 - DNA, 1473 bp, Bacillus cereus
atggcaattagaacaggggaacagtatattgaaggattacgaaaaagaaatcctgaaatttggattggtggaagaaaagtaacagatgtagtaaatgaagatgtttttcgcgaacccattttacaaattgctaacttatatgatatgcagcacaatctagaatatcaggataagattactcatatatgcgaagagacaggggaaagggtctcaaatgcctttttagtgccaaaaaattatgaggatttaaaagcacgtcgtgaattatttgaagtatgggcaaaagctaccttcggtttaatgggaagaacaccagattttttaaatgtaacagtaacttcaatggcaagtaattcttggttttttgagaagttcaatccagaatggggagcgaatataaagaattattataaacatatacgggataatgatttatttttaacacatgcgattattaatccgcaaaatgatcgtagtaaggcttctcatcaacaagaagatgaaactatgcatttaggtgtagtaagtgaaacagcagaagggatgtatgttagtggtgctaaaatgttagcgacactcgcccctattacagacgaggtaattatatattcctatccaagttttaagccaggtgatgaacgtcatgcaatctcttttgcagtaccaattgatgcaccaggactaagaattctttgtcgtgagccaatgcaagatggaaaacgttctctatttgatcatccacttgcatcaaggtttgaggaaatggatgcattactggtatttcataatgtgtttatcccatgggataaagtatttatttatcaaaatatagaagctgggaatcaattgtatcctaaaacgggaattggtcatcagccagcgcatcaatctggagtaagaggattagtaaagctttctttcgctgctgaagtagctatgaaattagcagattcgataggagtagatggatttttgaatgtacaaaaccagttagcagaacttatgcaagatgtagaaacgatacgtgcgctcttacaagtagctgagtatgaatatgaaaagaatccatatggagaagttattcctgcaaggttgccacttgatacaatacgcagtttattacctaaaatgtatccacgtgcaattgagattattcaaaccattggtgctggtggattattaatgtcaccgacaggtgcagattttatgaatcccgaaattcaagacgatatggaaaaatactatattgggcgtgaaggagtatcttctgaggaacgagttcgtttatttaaattagcatgggatttatgtggagaagcttttggacaacggttattacaatatgagcgttattattctggagatccggtacgtaaaatgggaatgttttataatgcgtacaaaaaacaacaaacgttttccctagtaaacaatgctttgcaatcaagttcatctgaaggtgctttaagttaa

SEQ ID NO: 17 - DNA, 1473 bp, Bacillus cereus
atggcaattagaacaggggaacagtatattgaaggattacgaaaaagaaatcctgaaatttggattggtggaagaaaagtaacagatgtagtaaatgaagatgtttttcgcgaacctattttacaaattgctaacttatatgatatgcagcacaatctagaatatcaggataagattactcatatatgcgaagagacaggggaaagggtctcaaatgcctttttagtgccaaaaaattatgaggatttaaaagcacgtcgtgaattatttgaagtatgggcaaaagctaccttcggtttaatgggaagaacaccagattttttaaatgtaacagtaacttcaatggcaagtaattcttggttttttgagaagttcaatccagaatggggagcgaatataaagaattattataaacatatacgggataatgatttatttttaacacatgcgattattaatccgcaaaatgatcgtagtaaggcttctcatcaacaagaagatgaaactatgcatttaggtgtagtaagtgaaacagcagaagggatgtatgttagtggtgctaaaatgttagcgacactcgcccctattacagacgaggtaattatatattcctatccaagttttaagccaggtgatgaacgtcatgcaatctcttttgcagtaccaattgatgcaccaggactaagaattctttgtcgtgagccaatgcaagatggaaaacgttctctatttgatcatccacttgcatcaaggtttgaggaaatggatgcattactagtatttcataatgtgtttatcccatgggataaagtatttatttatcaaaatatagaagctgggaatcaattgtatcctaaaacgggaattggtcatcagccagcgcatcaatctggagtaagaggattagtaaagctttctttcgctgttgaagtagctatgaaattagcagattcgataggagtagatggatttttgaatgtacaaaaccagttagcagaacttatgcaagatgtagaaacgatacgtgcgctcttacaagtagctgagtatgaatatgaaaagaatccatatggagaagttattcctgcaaggttgccacttgatacaatacgcagtttattacctaaaatgtatccacgtgcaattgagattattcaaaccattggtgctggtggattattaatgtcaccgacaggtgcagattttatgaatcccgaaattcaagacgatatggaaaaatactatattgggcgtgaaggagtatcttctgaggaacgagttcgtttatttaaattagcatgggatttatgtggagaagcttttggacaacggttattacaatatgagcgttattattctggagatccggtacgtaaaatgggaatgttttataatgcgtacaaaaaacaacaaacgttttccctagtaaacaatgctttgcaatcaagttcatctgaaggtgctttaagttaa

SEQ ID NO: 18 - DNA, 1473 bp, Bacillus cereus
atggcaattagaacaggagaacagtatattgaaggattgcgaaaaagaaatcctgaaatttggatgggtggaagaaaagtaacagatgtagtaaatgaagatgtttttcgcgaacctattttacaaattgctaacttatatgatatgcagcacaatccagaatatcaggataagattactcatatatgcgaagagacaggagaaagggtctcaaatgcatttttagtacccaaaaattatgaggacttaaaagcacgtcgtgaattatttgaaatatgggcaaaagctacctttggtttaatgggaagaacacctgattttttaaatgtaacagttacttcaatggcaagtaatgcatggttttttgagaagttcaatccagaatggggagcgaatataaagaactattataaacatatacgagataatgatttatttttaacacatgcgattattaatccgcaaaatgatcggagcaaggcttctcatcagcaagaagatgaaacaatgcatttaggtgtagtaagtgaaacagaggaagggatgtatgttagtggtgctaaaatgttagcgacacttgccccgattacagatgaggtaattatatattcctatccaagttttaaaccaggtgatgaacgtcatgcaatttcttttgccgttccaattgatgcaccaggactaaggattctttgtcgtgaaccaatgcaagatggaaaacgttctctatttgatcatccacttgcatcaaggtttgaggaaatggatgcattactagtatttcataatgtgtttatcccatgggataaagtatttatttatcaaagtgtagaagctgggaatcaattgtatcctaaaacgggaattggtcatcaaccagcgcatcaatctggagtaagagggttagttaagctatctttcgccgctgaagtagctatgaaattagcagattcgataggagtagacggttttttaaatgtacaaaaccagttagcagagcttatacaagatgtagaaacgatacgtgctctcttgcaagtagctgaatatgaatatgaaacgaatccatatggagaagttgttcctgcgaggttgccgcttgatacgatacgtagtttattacctaaaatgtatccgcgggctattgaaatcattcaaaccattggtgctggtgggctattgatgtcaccgacaggcgctgattttatgaaccctgagattcaagatgatatgcataaatattatatcgggcgtgaaggagtctcttctgaggaacgtgttcgcttgtttaaattagcttgggatttatgtggtgaagcttttggacaacgattattacaatatgagcgttactattctggagatccggtgcgtaaaatgggaatgttttatagtgcgtacaaaaaacaacaatcgctttctctagtgaagaaagctttgcaatcgagttcatccgagggcgctttaagctaa

SEQ ID NO: 19 - DNA, 1473 bp, Bacillus mycoides
atggcaattagaacaggggaacagtatattgaaggattacgagcaaaaaatcctgagatttggattggaggaagaaaagtaacagatgtggtgaatgaagaggtttttagggaaccaattttacaaattgctaacttatatgatatgcagcataatccagaatatcaagataagattactcatatatgcgaagagaccggagaaagggtttcgaatgcatttttagtgccgaaaaattatgaggacttaaaagcgcgtcgtgaattatttgaagtgtgggcaaaggctacctttggtttaatggggagaacaccagactttttaaatgtcacagttacttcaatggcaagtaatgcttggttttttgagaaattcgatccagaatggggcgcgaatataaaaaattattataagcatataagggataacgatttatttttaacacatgcaattattaatccacaaaacgatcggagtaaagcttctcatcaacaagaagatgaaacaatgcatttaggtgtggtaagtgaaacgaaggaagggatgtatgttagtggtgctaaaatgttagcgacacttgcaccgattacagatgaggtaatcatttattcctacccaagttttaaaccaggtgatgagcgtcatgcaatttcttttgcagttccaatcgatgcaccgggattaaggattctttgtcgtgagccaatgcaagatggaaaacgttctttatttgatcatccacttgcatcaaggtttgaagaaatggatgcattacttgtatttcacgatgtgtttatcccatgggataaagtatttatttatcaaagtgtagaagctggaaatcaattgtatcctaaaactggaattggtcatcagccagcacatcaatccggagtaagaggattagttaaactgtctttcgtagctgaagtagctataaagctagccgattcaataggtgtggatggatttttaaatgtacaaaatcagttagcagaacttatgcaggatgtagaaacaattcgtgctctcttgcaagtagctgaatatgaatatgaaacgaatccatatggagaggctattcctgcaaggttgccacttgatacaatacgtagcttattacctagaatgtatccgagggctatcgagattattcaaaccattggtgcgggtgggctattgatgtcaccaacaggtgctgattttatgaatccagagattcaagatgacatgcataaatattatattgggcgtgaaggagtatcttctgaagagcgtgttcgcttatttaaattagcttgggatttatgcggtgaagcttttggacaacgcttattacaatatgagcgttattactcgggggatccggttcgtaaaatgggcatgttttataatgcgcataaaaaacagcactctctgtcgcttgtgaacaatgctttgcaatcgagttcatctgaaaccgcattaagttaa

SEQ ID NO: 20 - DNA, 1677 bp, Bacillus cereus
gtgtctaaaaagaaaaaagatactgaaaaagaaaagaagaaagatgagaaaaaagatgaaagtaagaatgaaacgactgaaaatctaaatactaacgattttgatgaaatcattgataatgcaaagcgtagctcagatcaaaatttagccggaattattgaaaataacaaaaccaaaaagaaatatgatgatttatctgattcaattgcgaccgcagctataaattcagatagaaatctagcatcagttattgacggtgataaatcaaataatcgtttttcagatttaaatacttcaatagcatcggcaacaaacaatccttctgtctcggataataaggatagtaagaactttgtatttggtggcgatttaaacattaatgatggagttgctattgcagataactcaatatctccaattaatattgataaaaaaccaccaacttctggtgatacaagtggcggggaagtgaaaccgccaactggtggtgaaggtaataatggaggtagcacaaaaccaccaacaggcggagatggtaatgatggtggtacaacaaaaccagaaaaggatacagtgtcaccagtaattacagcaaagcaaggtgtaactgtacatgtaggagatagtttaaatgcaagtaatttagtagaagtaaaagataataaagacccaaacccagtagtaacagtaggagcgtacgatacaagtaaggcaggggaaattcaagtaacagtaacggcaacagatgcatcaggaaatagctcaagtacaacagtaactgtcaacgtagtcgaaaaagaagaagaaagagatacagaagcgccagtaattacagcgaagcaaggtgtgacagtgcatgtaggagatagtttaaatgtaggagacttggtagaagtaagagataataaagatccaaatccagtagtatcgatgggagagtatgatacaagtaaagcaggagaaatccaagtaacagtaacggcaacagatgcatcaggaaatagctcaagtacaacagtaaccgttaacgtagtcgaaaaagaggaagaaaaagacacagaggcaccagtaataacagcgaagcaaggtgtaaccgtacatgtaggagatagcttaaatgcaggtgatttagtagtggtaaaagataataaacacccaaatccagtagtgacagtaggtgcatatgatacaagcaaggcaggagaaattcaagtaacagtaacggcgacagatgcatcaggaaatagctcaagtacaacggtaactgtcaccgtagtcgagaaagaagaggagaaagatacagaagcaccagtaattacagtaaagcaaggtgtaaccgtacatgtaggagatagcttaaatgcaggtgatttagtagaagtaaaagataataaagatccaaatccagtagtaacagtgggagcgtatgatacaagtaagccatgtacaatatcagttcaagtaacggcaactgataaggcaggaaacagctcaactgaaacagtgaatgtggtagttcttgagaaagaaaaaccagaacagaagccagaacagaaaccagaacagaagccagaacaaaagccaaaacaaaagccaaaacagaaaaatgcaggaacaacttctaaagagcaggataatggattacttgcatcaaattctaatgatgtagctaaataa

SEQ ID NO: 21 - protein, 377 aa, Bacillus cereus
MNNVIIIGGGIAGLCAAISLQKIGLDVKVYDKNTEPTVAGAGIIIAPNAMQALELYGISKKIKKFGNESDGFNLVSEKGTTFNKLIIPTCYPKMYSIHRKDLHQLLLSELKEDTVKWGKECVKIEQNEANALKIVFQDGSEALGNILIAADGIHSVIRKQVTQGDNYRYAGYTCWRGVTPANNLSLTNDFIETWGTNGRFGIVPLPNNEVYWYALINAKARDPKYKAYTTTDLYNHFKTYHNPIPSILKNASDIDMIHRDIIDITPMKQFFDKRIVFIGDAAHALTPNLGQGACQAIEDAIILAECIKNNAHYRQAFLEYEQKRRDRIEKISNTAWKVGKMAQIESKPLTLVRNEVMKRMPKWVSEKRTHELYSFHL

SEQ ID NO: 22 - protein, 377 aa, Bacillus thuringiensis
MNNVIIIGGGIAGLCAAISLQKIGLDVKVYDKNTEPTVAGAGIIIAPNAMQALELYGISKKIKKFGNESDGFNLVSEKGTTFNKLIIPTCYPKMYSIHRKDLHQLLLSELKEDTVKWGKECVKIEQNEANALKIVFQDGSEALGNILIAADGIHSVIRKQVTQGDNYRYAGYTCWRGVTPANNLSLTNDFIETWGTNGRFGIVPLPNNEVYWYALINAKARDPKYKAYTTTDLYNHFKTYHNPIPSILQNASDIDMIHRDIIDITPMKQFFDKRIVFIGDAAHALTPNLGQGACQAIEDAIILAECIKNNAHYRQAFLEYEQKRRDRIEKISNTAWKVGKMAQIESKPLTLVRNEVMKRMPKWVSEKRTHELYSFHL

SEQ ID NO: 23 - protein, 377 aa, Bacillus cereus
MNNVIIIGGGIAGLCAAISLQKIGLDVKVYDKNTEPTVAGAGIIIAPNAMQALELYGISKKIKKFGNESDGFNLVSEKGTTFNKLIIPTCYPKMYSIHRKDLHQLLLSELKEDTVKWGKECVKIEQNEANALKIVFQDGSEALGNILIAADGIHSVIRKQVTQGDNYRYAGYTCWRGVTPANNLSLTNDFIETWGTNGRFGIVPLPNNEVYWYALINAKARDPKYKAYTTTDLYNHFKTYHNPIPSILQNASDVDMIHRDIIDITPMKQFFDKRIVFIGDAAHALTPNLGQGACQAIEDAIILAECIKNNAHYRQAFLEYEQKRRDRIEKISNTAWKVGKMAQIESKPLTLVRNEVMKRMPKWVSEKRTHELYSFHL

SEQ ID NO: 24 - protein, 377 aa, Bacillus cereus
MNNVIIIGGGIAGLCAAISLQKIGLDVKVYDKNTEPTVAGAGIIIAPNAMQALELYGISKKIKKFGNESNGFNLVSEKGTTFNKLIIPTCYPKMYSIHRKDLHQLLLSELKEDTVKWGKECVKIEQNEANALKIVFQDGSEALGNILIAADGIHSVIRKQVTQGDNYRYAGYTCWRGVTPANNLSLTNDFIETWGTNGRFGIVPLPNNEVYWYALINAKARDPKYKAYTTTDLYNHFKTYHNPIPSILKNASDIDMIHRDIIDITPMKQFFDKRIVFIGDAAHALTPNLGQGACQAIEDAIILAECIKNNAHYRQAFLEYEQKRRDRIEKISNTAWKVGKMAQIENKPLTLVRNEVMKRMPKWVSEKRTHELYSFHL

SEQ ID NO: 25 - protein, 377 aa, Bacillus thuringiensis
MNNVIIIGGGIAGLCAAISLQKIGLDVKVYDKNTEPTVAGAGIIIAPNAMQALELYGISKKIKKFGNESDGFNLVSEKGTTFNKLIIPTCYPKMYSIHRKDLHQLLLSELKEHTVKWGKECVKIEQNEANALKIVFQDGSQALGNILIAADGIHSVIRKQVTQGDNYRYAGYTCWRGVTPANNLSLTNDFIETWGTNGRFGIVPLPNNEVYWYALINAKARDPKYKAYTTTDLYNHFKTYHNPIPSILKNASDIDMIHRDIIDITPMKQFFDKRIVFIGDAAHALTPNLGQGACQAIEDAIILAECIKNNAHYRQAFLEYEQKRRDRIEKISNTAWKVGKMAQIESKPLTLVRNEVMKRMPKWVSEKRTHELYSFHL

SEQ ID NO: 26 - protein, 377 aa, Bacillus cereus
MNNVIIIGGGIAGLCAAISLQKIGIEVKVYDKNNEPTVAGAGIIIAPNAMQALELYGISKKIKKFGNESDGFNLVSEKGTTFNKLIIPTCYPKMYSIHRKDLHQLLLSELKEDTVKWGKECVKIEQNEASALKIVFQDGSEALGNILIAADGIHSVIRKQVTQGDNYRYAGYTCWRGVTPANNLSLTNDFIETWGTNGRFGIVPLPNNEVYWYALINAKARDQKYKAYTTTDLYNHFKTYHNPIPSILKNASDIDMIHRDIIDITPMKQFFDKRIVFIGDAAHALTPNLGQGACQAIEDAIILAECIKNNAHYRQAFLEYEQKRRDRIEKISNTAWKVGKMAQIESKPLTIVRNEVMKRMPKWVSEKQTHELYSFHL

SEQ ID NO: 27 - protein, 377 aa, Bacillus cereus
MNNVIIIGGGIAGLCAAISLQKIGIEVKVYDKNNEPTVAGAGIIIAPNAMQALELYGISKKIKKFGNESDGFNLVSEKGTTFNKLIIPTCYPKMYSIHRKDLHQLLLCELKEDTVKWGKECVKIEQNEASALKIVFQDGSEALGNILIAADGIHSVIRKQVTQGDNYRYAGYTCWRGVTPANNLSLTNDFIETWGTNGRFGIVPLPNNEVYWYALINTKARDQKYKAYTTTDLYNHFKTYHNPIPSILKNASDIDMIHRDIIDITPMKQFFDKRIVFIGDAAHALTPNLGQGACQAIEDAIILAECIKNNAHYRQAFIEYEQKRRDRIEKISNTAWTVGKMAQIESKPLTIVRNEVMKRIPKWISERQAHELYNFHL

SEQ ID NO: 28 - protein, 377 aa, Bacillus cereus
MNNVIIIGGGIAGLCAAISLQKIGLDVKVYDKNTEPTVAGAGIIIAPNAMQALELYGISKKIKKFGNESDGFNLVSEKGTTFNKLIIPTCYPKMYSIHRKDLHQLLLSELKEDTVKWGKECVKIEQNEENALKIVFQDGSEALGNILIAADGIHSIVRKQVTQGDNYRYAGYTCWRGVTPTKNLSLTNDFIETWGTNGRFGIVPLPNNEVYWYALINAKARDPKYKAYTTTDLYNHFKTYHNPIPSILQNASDVDMIHRDIIDITPMKQFFDKRIVFIGDAAHALTPNLGQGACQAIEDAIILAECIKNNAYYRQAFTEFEQKRRDRIEKISNTAWKVGKVAQIESKPLTIVRNKVMKRIPKWISERQAHELYKFHL

SEQ ID NO: 29 - protein, 377 aa, Bacillus thuringiensis
MNNVIIIGGGIAGLCAAISLQKIGLDVKVYDKNTEPTVAGAGIIIAPNAMQALELYGISKKIKKFGNESDGFNLVSKKGTTFNKLIIPTCYPKMYSIHRKDLHQLLLSELKEDTVKWGKECVKIEQNEENALKIVFQDGSEALGNILIAADGIHSIVRKQVTQGDNYRYAGYTCWRGVTPTKNLSLTNDFIETWGTNGRFGIVPLPNNEVYWYALINAKARDPKYKAYTTTDLYNHFKTYHNPIPSILQNASDIDMIHRDIIDITPMKQFFDKRIVFIGDAAHALTPNLGQGACQAIEDAIILAECIKNNAYYRQAFTEFEQKRRDRIEKISNTAWKVGKIAQIESKPLTIVRNKVMKRIPKWISERQAHELYRFHL

SEQ ID NO: 30 - protein, 490 aa, Bacillus cereus
MAIRTGEQYIEGLRKRNPEIWIGGRKVTDVVNEDVFREPIIQIANLYDMQHNPEYQDKITHICEETGERVSNAFLVPRNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 31 - protein, 490 aa, Bacillus cereus
MAIRTGEQYIEGLRKRNPEIWIGGRKVTDVVNEDVFREPIIQIANLYDMQHNPEYQDKITHICEETGERVSNAFLVPKNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDELIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 32 - protein, 490 aa, Bacillus cereus
MAIRTGEQYIEGLRKRNPEIWIGGRKVTDVVNEDVFREPILQIANLYDMQHNPEYQDKITHICEETGERVSNAFLVPKNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSEAAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIQDDMQKYYIGREGVSSEERVRLFKLAWDLCGEAFGQRLLQYERYYSGDPVRKMGMFYNAYKKQQTFSLVNNALQSSSSEGALS

SEQ ID NO: 33 - protein, 490 aa, Bacillus cereus; identical to SEQ ID NO: 32

SEQ ID NO: 34 - protein, 490 aa, Bacillus cereus
MGIRTGEQYIEGLRKRNPEIWIGGRKVTDVVNEDIFREPILQIANLYDMQHHPEYQDKITHICEETGERVSNAFLVPKNYEDLKARRELFEVWAKATFGLMGRTPDFLNVTVTSMASNSWFFEKFNSEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKVADSIGVDGFLNVQNQLAELMQDVETIRALLQVAEYEYETNSYGEVIPARLPLDTIRSLLPKMYPRAIEIIQTIGAGGLLMSPTGADFMTPEIQDDMQKYYIGREGVSSEERVRLFKLAWDLCGEAFGQRLLQYERYYSGDPVRKMGMFYNAYKKQQTFSLVNNALQSSSSEGALS

SEQ ID NO: 35 - protein, 490 aa, Bacillus cereus
MAIRTGEQYIEGLRKRNPEIWIGGRKVTDVVNEDVFREPILQIANLYDMQHNPEYQDKITHICEETGERVSNAFLVPKNYEDLKARRELFEVWAKATFGLMGRTPDFLNVTVTSMASNSWFFEKFDSEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQNIEAGNQLYPKTGIGHQPAHQSGVRGLVKLSFAAEVAMKLADSIGVDGFLNVQNQLAELMQDVETIRALLQVAEYEYETNPYGEVVPARLPLDTIRSLLPKMYPRAIEIIQTIGAGGLLMSPTGADFMNPEIQDDMEKYYIGREGVSSEERVRLFKLAWDLCGEAFGQRLLQYERYYSGDPVRKMGMFYNAYKKQQTFSLVNNALQSSSSEGALS

SEQ ID NO: 36 - protein, 490 aa, Bacillus cereus
MAIRTGEQYIEGLRKRNPEIWIGGRKVTDVVNEDVFREPILQIANLYDMQHNLEYQDKITHICEETGERVSNAFLVPKNYEDLKARRELFEVWAKATFGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQNIEAGNQLYPKTGIGHQPAHQSGVRGLVKLSFAAEVAMKLADSIGVDGFLNVQNQLAELMQDVETIRALLQVAEYEYEKNPYGEVIPARLPLDTIRSLLPKMYPRAIEIIQTIGAGGLLMSPTGADFMNPEIQDDMEKYYIGREGVSSEERVRLFKLAWDLCGEAFGQRLLQYERYYSGDPVRKMGMFYNAYKKQQTFSLVNNALQSSSSEGALS

SEQ ID NO: 37 - protein, 490 aa, Bacillus cereus
MAIRTGEQYIEGLRKRNPEIWIGGRKVTDVVNEDVFREPILQIANLYDMQHNLEYQDKITHICEETGERVSNAFLVPKNYEDLKARRELFEVWAKATFGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQNIEAGNQLYPKTGIGHQPAHQSGVRGLVKLSFAVEVAMKLADSIGVDGFLNVQNQLAELMQDVETIRALLQVAEYEYEKNPYGEVIPARLPLDTIRSLLPKMYPRAIEIIQTIGAGGLLMSPTGADFMNPEIQDDMEKYYIGREGVSSEERVRLFKLAWDLCGEAFGQRLLQYERYYSGDPVRKMGMFYNAYKKQQTFSLVNNALQSSSSEGALS

SEQ ID NO: 38 - protein, 490 aa, Bacillus cereus
MAIRTGEQYIEGLRKRNPEIWMGGRKVTDVVNEDVFREPILQIANLYDMQHNPEYQDKITHICEETGERVSNAFLVPKNYEDLKARRELFEIWAKATFGLMGRTPDFLNVTVTSMASNAWFFEKFNPEWGANIKNYYKHIRDNDLFLTHAIINPQNDRSKASHQQEDETMHLGVVSETEEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELIQDVETIRALLQVAEYEYETNPYGEVVPARLPLDTIRSLLPKMYPRAIEIIQTIGAGGLLMSPTGADFMNPEIQDDMHKYYIGREGVSSEERVRLFKLAWDLCGEAFGQRLLQYERYYSGDPVRKMGMFYSAYKKQQSLSLVKKALQSSSSEGALS

SEQ ID NO: 39 - protein, 490 aa, Bacillus mycoides
MAIRTGEQYIEGLRAKNPEIWIGGRKVTDVVNEEVFREPILQIANLYDMQHNPEYQDKITHICEETGERVSNAFLVPKNYEDLKARRELFEVWAKATFGLMGRTPDFLNVTVTSMASNAWFFEKFDPEWGANIKNYYKHIRDNDLFLTHAIINPQNDRSKASHQQEDETMHLGVVSETKEGMYVSGAKMLATLAPITDEVIIYSYPSFKPGDERHAISFAVPIDAPGLRILCREPMQDGKRSLFDHPLASRFEEMDALLVFHDVFIPWDKVFIYQSVEAGNQLYPKTGIGHQPAHQSGVRGLVKLSFVAEVAIKLADSIGVDGFLNVQNQLAELMQDVETIRALLQVAEYEYETNPYGEAIPARLPLDTIRSLLPRMYPRAIEIIQTIGAGGLLMSPTGADFMNPEIQDDMHKYYIGREGVSSEERVRLFKLAWDLCGEAFGQRLLQYERYYSGDPVRKMGMFYNAHKKQHSLSLVNNALQSSSSETALS

SEQ ID NO: 40 - protein, 558 aa, Bacillus cereus
VSKKKKDTEKEKKKDEKKDESKNETTENLNTNDFDEIIDNAKRSSDQNLAGIIENNKTKKKYDDLSDSIATAAINSDRNLASVIDGDKSNNRFSDLNTSIASATNNPSVSDNKDSKNFVFGGDLNINDGVAIADNSISPINIDKKPPTSGDTSGGEVKPPTGGEGNNGGSTKPPTGGDGNDGGTTKPEKDTVSPVITAKQGVTVHVGDSLNASNLVEVKDNKDPNPVVTVGAYDTSKAGEIQVTVTATDASGNSSSTTVTVNVVEKEEERDTEAPVITAKQGVTVHVGDSLNVGDLVEVRDNKDPNPVVSMGEYDTSKAGEIQVTVTATDASGNSSSTTVTVNVVEKEEEKDTEAPVITAKQGVTVHVGDSLNAGDLVVVKDNKHPNPVVTVGAYDTSKAGEIQVTVTATDASGNSSSTTVTVTVVEKEEEKDTEAPVITVKQGVTVHVGDSLNAGDLVEVKDNKDPNPVVTVGAYDTSKPCTISVQVTATDKAGNSSTETVNVVVLEKEKPEQKPEQKPEQKPEQKPKQKPKQKNAGTTSKEQDNGLLASNSNDVAK

SEQ ID NO: 41 - protein, 377 aa, Bacillus anthracis; identical to SEQ ID NO: 23

SEQ ID NO: 42 - protein, 377 aa, Bacillus subtilis
MNNVIIIGGGIAGLCAAISLQKIGLDVKVYDKNTEPTVAGAGIIIAPNAMQALELYGISKKIKKFGNESDGFNLVSEKGTTFNKLIIPTCYPKMYSIHRKDLHQLLLSELKADTVKWGKECVKIEQNEANALKIVFQDGSEALGNILIAADGIHSVIRKQVTQGDNYRYAGYTCWRGVTPANNLSLTNDFIETWGTNGRFGIVPLPNNEVYWYALINAKARDPKYKAYTTTDLYNHFKTYHNPIPSILKNASDIDMIHRDIIDITPMKQFFDKRIVFIGDAAHALTPNLGQGACQAIEDAIILAECIKNNAHYRQAFLEYEQKRRDRIEKISNTAWKVGKMAQIESKPLTLVRNEVMKRMPKWVSEKRTHELYSFHL

SEQ ID NO: 43 - protein, 377 aa, Bacillus cereus; identical to SEQ ID NO: 24

SEQ ID NO: 44 - protein, 377 aa, Bacillus sp.
MNNVIIIGGGIAGLCAAISLQKIGLDVKVYDKNTEPTVAGAGIIIAPNAMQALELYGISKKIKKFGNESDGFNLVSEKGTTFNKLIIPTCYPKMYSIHRKDLHQLLLSELKEDTVKWGKECVKIEQNEANALKIVFQDGSEAFGNILIAADGIHSVVRKQVTQRDNYRYAGYTCWRGITPTNNLSLTNDFIETWGTNGRFGIVPLPNNEVYWYALINAKARDPKYKAYTTTDLYNHFKTYHNPIPSILKNASDIDMIHRDIIDITPMKQFFDKRIVFIGDAAHALTPNLGQGACQAIEDAIILAECIKNNAHYRQAFLEYEQKRRDRIEKISNTAWKVGKMAQIESKPLTIVRNEVMKRMPKWVSEKQTHELYSFHL

SEQ ID NO: 45 - protein, 377 aa, Bacillus cereus; identical to SEQ ID NO: 26

SEQ ID NO: 46 - protein, 377 aa, Bacillus cereus
MNNVIIIGGGIAGLCAAISLQKIGIEVKVYDKNNEPTVAGAGIIIAPNAMQALELYGISKKIKKFGNESDGFNLVSEKGTTFNKLIIPTCYPKMYSIHRKDLHQLLLSELKEDTVKWGKECVKIEQNEASALKIVFQDGSEALGNILIAADGIHSVIRKQVTQGDNYRYAGYTCWRGVTPANNLSLTNDFIETWGTNGRFGIVPLPNNEVYWYALINAKARDQKYKAYTTTDLYNHFKTYHNPIPSILKNASDIDMIHRDIIDITPMKQFFDKRIVFIGDAAHALTPNLGQGACQAIEDAIILAECIKNNAHYRQAFIEYEQKRRDRIEKISNTAWKVGKMAQIESKPLTIVRNEVMKRMPKWVSEKQTHELYSFHL

SEQ ID NO: 47 - protein, 377 aa, Bacillus cereus
MNNVIIIGGGIAGLCAAISLQKIGIEVKVYDKNNEPTVAGAGIIIAPNAMQALELYGISKKIKKFGNESDGFNLVSEKGTTFNKLIIPTCYPKMYSIHRKDLHQLLLSELKEDTVKWGKECVKIEQNEASALKIVFQDGSEALGNILIAADGIHSVIRKQVTQGDNYRYAGYTCWRGVTPANNLSLTNDFIETWGANGRFGIVPLPNNEVYWYALINAKARDQKYKAYTTTDLYNHFKTYHNPIPSILKNASDIDMIHRDIIDITPMKQFFDKRIVFIGDAAHALTPNLGQGACQAIEDAIILAECIKNNAHYRQAFLEYEQKRRDRIEKISNTAWKVGKMAQIESKPLTIVRNEVMKRMPKWVSEKQTHELYSFHL

SEQ ID NO: 48 - protein, 377 aa, Bacillus sp.
MNNVIIIGGGIAGLCAAISLQKIGLDVKVYDKNTEPTVAGAGIIIAPNAMQALELYGISKQIKKFGNESDGFNLVSEKGTTFNKLIIPTCYPKMYSIHRKDLHQLLLSELKEDTVKWGKECVKIEQNEENALKIVFQDGSEALGNILIAADGIHSIVRKQVTQGDNYRYAGYTCWRGVTPTKNLSLTNDFIETWGTNGRFGIVPLPNNEVYWYALINAKARDPKYKAYTTTDLYNHFKTYHNPIPSILQNASDVDMIHRDIIDITPMKQFFDKRIVFIGDAAHALTPNLGQGACQAIEDAIILAECIKNNAYYRQAFTEFEQKRRDRIEKISNTAWKVGKIAQIESKPLTIVRNKVMKRIPKWISERQAHELYRFHL

SEQ ID NO: 49 - protein, 377 aa, Bacillus thuringiensis; identical to SEQ ID NO: 29

SEQ ID NO: 50 - protein, 377 aa, Streptococcus pneumoniae
MNNVIIIGGGIAGLCAAISLQKIGLDVKVYDKNTEPTVAGAGIIIAPNAMQALELYGISKKIKKFGNESDGFNLVSKKGTTFNKLIIPTCYPKMYSIHRKDLHQLLLSELKEDTVKWGKECVKIEQNEENALKIVFQDGSEALGNILIAADGIHSIVRKQVTQGDNYRYAGYTCWRGVTPTKNLSLTNDFIETWGTNGRFGIVPLPNNEVYWYALINAKARDPKYKAYTTTDLYNHFKTYHNPIPSILQNASDIDMIHRDIIDITPMKQFFDKRILFIGDAAHALTPNLGQGACQAIEDAIILAECIKNNAYYRQAFTEFEQKRRDRIEKISNTAWKVGKIAQIESKPLTIVRNKVMKRIPKWISERQAHELYRFHL

SEQ ID NO: 51 - protein, 490 aa, Bacillus cereus
MAIRTGEQYIEGLRKRNPEIWIGGRKVTDVVNEDVFREPIIQIANLYDMQHNPEYQDKITHICEETGERVSNAFLVPRNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEIIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 52 - protein, 490 aa, Bacillus thuringiensis
MAIRTGEQYIEGLRKRNPEIWIGGRKVTDVVNEDVFREPIIQIANLYDMQHNPEYQDKITHICEETGERVSNAFLVPRNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRNLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 53 - protein, 490 aa, Bacillus cereus
MAIRTGEQYIEGLRKRNPEIWIGGRKVTDVVNEDVFREPIIQIANLYDMQHNPEYQDKITHICEETGERVSNAFLVPRNYEDLKVRRELFEVWAKATYGLMGRTPDFLNVTVTSMASNSWFFEKFNPEWGANIKNYYKHIRDNDLFLTHAIINPQNDRSKASHQQEDETLHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 54 - protein, 490 aa, Bacillus cereus; identical to SEQ ID NO: 53

SEQ ID NO: 55 - protein, 490 aa, Bacillus cereus
MAIRTGEQYIEGLRKRNPEIWIGGRKVTDVVNEDVFREPIIQIANLYDMQHNSEYQDKITHICEETGERVSNAFLVPRNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 56 - protein, 490 aa, Bacillus thuringiensis
MAIRTGEQYIEGLRKRNPEIWIGGRKVTDVVNEDVFREPILQIANLYDMQHNPEYQDKITHICEETGERVSNAFLVPKNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFRPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 57 - protein, 490 aa, Bacillus cereus
MAIRTGEQYIEGLRKRNPEIWIGGRKVTDVVNEDVFREPILQIANLYDMQHNPEYQDKITHICEETGERVSNAFLVPKNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFRPGDERHAISFAVPIDAPGLRILCREPMQDGKRSLFDHPLASRFEEMDALLVFHNVFIPWNKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 58 - protein, 490 aa, Bacillus cereus
MAIRTGEQYIEGLRKRNPEIWIGGRKVTDVVNEDVFREPIIQIANLYDMQHNPEYQDKITHICEETGERVSNAFLVPRNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQGVETIRALLQVAEYEYETNSYGEVIPARLPLDTIRSLLPKMYPRAIEIIQTIGAGGLLMSPTGADFMNSEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 59 - protein, 490 aa, Bacillus thuringiensis
MGIRTGEQYIEGLRKRNPEIWIGGRKVTDVVNEDVFREPILQIANLYDMQHNPEYQDKITHICEETGERVSNAFLVPKNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFRPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 60 - protein, 490 aa, Bacillus cereus
MGIRTGEQYIEGLRKRNPEIWIGGRKVTDVVNEDVFREPILQIANLYDMQHNPEYQDKTTHICEETGERVSNAFLVPKNYEDLKVRRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFRPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 61 - protein, 490 aa, Bacillus cereus
MAIRTGEQYIEGLRKRNPEIWIGGRKVTDVVNEDVFREPIIQIANLYDMQHNPEYQDKITHICGETGERVSNAFLVPKNYEDLKVRRELFEVWAKATYGLMGRTPDFLNVTITSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNSYGEVIPARLPLDTIRSLLPKMYPRAIEIIQTIGAGGLLMSPTGADFMNPEIQDDMQKYYIGREGVSSEERVRLFKLAWDLCGEAFGQRLLQYERYYSGDPVRKMGMFYNAYKKQQTFSLVNNALQSSSSEGALS

SEQ ID NO: 62 - protein, 490 aa, Bacillus cereus
MGIRTGEQYIEGLRKRNPEIWIGGRKVTDVVNEDVFREPILQIANLYDMQHHPEYQDKITHICEETGERVSNAFLVPKNYEDLKARRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKVADSIGVDGFLNVQNQLAELMQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 63 - protein, 490 aa, Bacillus cereus
MGIRTGEQYIEGLRKRNPEIWIGGRKVTDVVNEDVFREPILQIANLYDMQHHPEYQDKITHICEETGERISNAFLVPKNYEDLKARRELFEVWAKATYGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKVADSIGVDGFLNVQNQLAELIQDVETIRALLQVAEYEYETNSYGEVIPARLPLDTIRSLLPKMYPRAIEIIQTIGAGGLLMSPTGADFMNPEIHDDMQKYYIGREGVSSEERVRLFKLAWDLCGEAFGQRLLQYERYYSGDPVRKMGMFYNAYKKQQTFSLVNNALQSSSSEGALS

SEQ ID NO: 64 - protein, 490 aa, Bacillus cereus
MGIRTGEQYIEGLRKRNPEIWIGGRKVTDVVNEDVFREPILQIANLYDMQNHPEYQDKITHICEETGERVSNAFLVPKNYEDLKARRELFEIWAKATFGLMGRTPDFLNVTVTSMASNSWFFEKFNPEWGANIKNYYKHIRDNDLFLTHAIINPQNDRSKASHQQEDETMHLGVVSETAEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKVADSIGVDGFLNVQNQLAELMQDVETIRALLQVAEYEYETNSYGEVIPARLPLDTIRSLLPKMYPRAIEIIQTIGAGGLLMSPTGADFMTPEIQDDMQKYYIGREGVSSEERVRLFKLAWDLCGEAFGQRLLQYERYYSGDPVRKMGMFYNAYKKQQTFSLVNNALQSSSSEGALS

SEQ ID NO: 65 - protein, 490 aa, Bacillus cereus; identical to SEQ ID NO: 34

SEQ ID NO: 66 - protein, 490 aa, Bacillus cereus; identical to SEQ ID NO: 36

SEQ ID NO: 67 - protein, 490 aa, Bacillus cereus
MGIRTGEQYIEGLRKRNPEIWIGGRKVTDVVNEDVFREPILQIANLYDMQHHPEYQDKITHICEETGERVSNAFLVPKNYEDLKARRELFEVWAKATFGLMGRTPDFLNVTVTSMASNSWFFEKFNPEWGANIKNYYKHIKDNDLFLTHAIINPQNDRSKASHQQEDETMHLGVVSETAEGMYVSGAKMLATLAPITDEVIIYSYPSFKPGDERHAISFAVPIDAPGLRVLCREPMQDGKRSLFDHPLASRFEEMDALLVFHNVFIPWDKVFIYQSVEAGNQLYPKTGIGHQPAHQSGVRGLVKLSFAAEVAMKVADSIGVDGFLNVQNQLAELMQDVETIRALLQVAEYEYETNSYGEVIPARLPLDTIRSLLPKMYPRAIEIIQTIGAGGLLMSPTGADFMTPEIQDDMQKYYIGREGVSSEERVRLFKLAWDLCGEAFGQRLLQYERYYSGDPVRKMGMFYNAYKKQQTFSLVNNALQSSSSEEALS

SEQ ID NO: 68 - protein, 490 aa, Bacillus cereus
  misc_feature (164)..(164): Xaa can be any naturally occurring amino acid
MGIRTGEQYIEGLRKRNPEIWIGGRKVTDVVNEDVFREPILQIANLYDMQHHPEYQDKITHICEETGERVSNAFLVPKNYEDLKARRELFEVWAKATFGLMGRTPDFLNVTVTSMASNSWFFEKFNPEWGANIKNYYKHIKDNDLFLTHAIINPQNDRSKASHXQEDETMHLGVVSETAEGMYVSGAKMLATLAPITDEVIIYSYPSFKPGDERHAISFAVPIDAPGLRVLCREPMQDGKRSLFDHPLASRFEEMDALLVFHNVFIPWDKVFIYQSVEAGNQLYPKTGIGHQPAHQSGVRGLVKLSFAAEVAMKVADSIGVDGFLNVQNQLAELMQDVETIRALLQVAEYEYETNSYGEVIPARLPLDTIRSLLPKMYPRAIEIIQTIGAGGLLMSPTGADFMTPEIQDDMQKYYIGREGVSSEERVRLFKLAWDLCGEAFGQRLLQYERYYSGDPVRKMGMFYNAYKKQQTFSLVNNALQSSSSEEALS

SEQ ID NO: 69 - protein, 490 aa, Bacillus sp.
MAIRTGEQYIEGLRKRNPEIWMGGRKVTDVVNEDVFREPILQIANLYDMQHNPEYQDKITHICEETGERVSNAFLVPKNYEDLKARRELFEIWAKATFGLMGRTPDFLNVTVTSMASNAWFFEKFNPEWGANIKNYYKHIRDNDLFLTHAIINPQNDRSKASHQQEDETMHLGVVSETEEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNPYGEVVPARLPLDTIRSLLPKMYPRAIEIIQTIGAGGLLMSPTGADFMNPEIQDDMHKYYIGREGVSSEERVRLFKLAWDLCGEAFGQRLLQYERYYSGDPVRKMGMFYSAYKKQQSLSLVKKALQSSSSEGALS

SEQ ID NO: 70 - protein, 490 aa, Bacillus sp.
MAIRTGEQYIEGLRKRNPEIWMGGRKVTDVVNEDVFREPILQIANLYDMQHNPEYQDKITHICEETGERVSNAFLVPKNYEDLKARRELFEIWAKATFGLMGRTPDFLNVTVTSMASNAWFFEKFNPEWGANIKNYYKHIRDNDLFLTHAIINPQNDRSKASHQQEDETMHLGVVSETEEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAMKLADSIGVDGFLNVQNQLAELMQDVETIRALLQVAEYEYETNPYGEVVPARLPLDTIRSLLPKMYPRAIEIIQTIGAGGLLMSPTGADFMNPEIQDDMHKYYIGREGVSSEERVRLFKLAWDLCGEAFGQRLLQYERYYSGDPVRKMGMFYSAYKKQQSLSLVKEALQSSSSEGALS

SEQ ID NO: 71 - protein, 557 aa, Bacillus cereus
VSKKKKDTEKEKKKDEKKDESKNETTENLNTNDFDEIIDNAKRSSDQNLAGIIENNKTKKKYDDLSDSIATAAINSDRNLASVIDGDKSNNRFSDLNTSIASATNNPSVSDNKDSKNFVFGGDLNINDGVAIADNSISPINIDKKPPTSGDTSGGEVKPPTGGEGNNGGSTKPPTGGDGNDGGTTKPEKDTVSPVITAKQGVTVHVGDSLNASNLVEVKDNKDPNPVVTVGAYDTSKAGEIQVTVTATDASGNSSSTTVTVNVVEKEEERDTEAPVITAKQGVTVHVGDSLNVGDLVEVRDNKDPNPVVSMGEYDTSKAGEIQVTVTATDASGNSSSTTVTVNVVEKEEEKDTEAPVITAKQGVTVHVGDSLNAGDLVVVKDNKHPNPVVTVGAYDTSKAGEIQVTVTATDASGNSSSTTVTVTVVEKEEEKDTEAPVITVKQGVTVHVGDSLNAGDLVEVKDNKDPNPVVTVGAYDTSKPCTISVQVTATDKAGNSSTETVNVVVLEKEKPEQKPEQKPEQKPEQKPKQKPKQKNAGTTSKEQDNGLLASNSNDVA

SEQ ID NO: 72 - DNA, 501 bp, Bacillus mycoides
atgaaagaacttaaccaatttttaggaagccatttcatttatacttatgaaaatggttgggaatatgaattttatataaaaaatgaggatactgttgactatcgtattcatagtgggatggttggaggtcgctgggttcgtgaccaaaaagctgatattgtaaaaatcgctgatggagtctataaagtttcatggactgagcctactggcactgacgtttccctaaatttcatgccaaatgacaaaaggatacatggagtcatcttcttccctaaatgggtacatgaacatccagaaattacagtttgttaccaaaatgactttattaatgtaatggaagaatcccgtttaaaatatgagacttatcctaaatatgttgtccctgagttcgctgatatcacttttttcaaaaatgaaggaatcaataatgaaaaagttatatctcaagatccttatgaaggtatgactaatgatatccgttcaggaaaattaactttttaa

SEQ ID NO: 73 - protein, 166 aa, Bacillus mycoides
MKELNQFLGSHFIYTYENGWEYEFYIKNEDTVDYRIHSGMVGGRWVRDQKADIVKIADGVYKVSWTEPTGTDVSLNFMPNDKRIHGVIFFPKWVHEHPEITVCYQNDFINVMEESRLKYETYPKYVVPEFADITFFKNEGINNEKVISQDPYEGMTNDIRSGKLTF

SEQ ID NO: 74 - DNA, 849 bp, Bacillus cereus
atgaataaaaaaaagaaaatacaaaaatcagtactttcctttaccctgctcttttctttaggcatttcatctttttcgcttacaacagctattcacgcagatacacgtgaggaaccatctgtagaaaaaaaacgagtctctttaacggagcgtacatcattattttttgaatatctccagcaaggtaattatgtagaggcacttcagttgacgtctgctgcttttcaatccaagttcacagcaaacacattacaaaactggtggacacaaagtggttggagcgtgataaaaatcataggaacccccgtgataaaagaacgaaacttagtccatcagacggtggaaatttcaggaactacccaaggtactaccataccgttactccttaaattcacacctggggggaaagtagatgaggttggggtaaggacgcctccggaatcttatattatcccgcatcctagctatgatcaacctgctttctatcaagaacgtgaaatcgtcattggaaattctacctatccgttaccagccacattaacagttccgaaacataaagctggtgagaaggtacccgtagttgttcttgttcatggtgctggcatccacgatcgcgatagtacatatatgggaacaaaaattttacgagaccttgcggtaggcctttcgtccaacggaattgcagtgttgcgctatgaaaaacgcaccttagaacacgcattaaagatgagtgcagaacctgttacgttagaccgtgatactacagatgatgccatatatgcagcaaaatcagcagcgcacaggaaggcattgatccaaacaatattttcattcttggacatagtctag

SEQ ID NO: 75 - DNA, 933 bp, Bacillus cereus
atgaataaaaaaaagaaaatacaaaaatcagtactttcctttaccctgctcttttctttaggcatttcatctttttcgcttacaacagctattcacgcagatacacgtgaggaaccatctgtagaaaaaaaacgagtctctttaacggagcgtacatcattattttttgaatatctccagcaaggtaattatgtagaggcacttcagttgacgtctgctgcttttcaatccaagttcacagcaaacacattacaaaactggtggacacaaagtggttggagcgtgataaaaatcataggaacccccgtgataaaagaacgaaacttagtccatcagacggtggaaatttcaggaactacccaaggtactaccataccgttactccttaaattcacacctggggggaaagtagatgaggttggggtaaggacgcctccggaatcttatattatcccgcatcctagctatgatcaacctgctttctatcaagaacgtgaaatcgtcattggaaattctacctatccgttaccagccacattaacagttccgaaacataaagctggtgagaaggtacccgtagttgttcttgttcatggtgctggcatccacgatcgcgatagtacatatatgggaacaaaaattttacgagaccttgcggtaggcctttcgtccaacggaattgcagtgttgcgctatgaaaaacgcaccttagaacacgcattaaagatgagtgcagaacctgttacgttagaccgtgatactacagatgatgccatatatgcagcaaaatcagcagcgcagcaggaaggcattgatccaaacaatattttcattcttggacatagtctaggagctggcacaatgccgcgtatactaagcaaagcaccttccttacttgttagaggaagtatcctactcgcaccacctgcacgg

SEQ ID NO: 76 - DNA, 1272 bp, Bacillus cereus
atgaatgaacaaaatgaagtgatagaaaatggatatatcattgtagaaaatgatcaaattatagatgtgaagagcggagaattcgctaatgattttgaagtagatgaagtaattgacatgaaaggaaagtgggttttaccagggcttgtaaatacacatacacacgttgtaatgagtctcttaagaggtattggtgatgatatgttattacagccgtggcttgagacgagaatttggccacttgaaagtcagtttactccagagcttgcggtcgctagtacggaattaggattacttgaaatggtgaaaagtggtacaacatcattctctgatatgtttaatccaattggagtagatcaagatgcaattatggaaacggtatcaaggagcgggatgcgagctgctgtttcaagaactttatttagcttcggaacgaaagatgatgaaaaaaaagccattgaagaagctgaaaaatatgtgaagcgttactataacgaaagtggtatgttaactacgatggttgcaccgcatagtccatatacatgcagtacagaactgttagaagagtgcgctcgtattgcagtagaaaatcaaacgatggttcatatacatctttcggaaacagagcgtgaagtacgtgatattgaagcacagtacggaaaacgtccagtagaatatgcagcaagttgcggattgtttaaacgcccaacagttattgcacacggtgtagtattaaatgaaaatgagcgtgcatttttagcagaacatgatgttcgagtagcacataacccgaatagtaatttaaaactaggttctggtatagcgaatgtaaaagcgatgctagaagcaggaatgaaagtaggaattgcaacagatagtgtggcatcaaacaacaatttagatatgtttgaagaaatgcgtatagcgactttactacaaaaaggtattcatcaagatgcaacagcgttaccggttgaaacagctcttacacttgcaactaaaggagcggctgaagtaatcggcatgaaacaaacaggatcacttgaggttggaaagtgcgctgatttcattacaattgatccgtctaataagcctcatttacaaccagcggatgaagtgttatcacaccttgtatatgctgctagtggaaaagatataagcgatgtaattattaacggaaaacgtgtcgtttggaatggcgaatgtaaaacgttagatgaagagcgtattatatttgaagcaagtcgttataaacgaggtttgcaaagatag

SEQ ID NO: 77 - DNA, 1308 bp, Bacillus cereus
ttgaaaacaacttatgtaaacgctacaatagtaacgatgaatgaacaaaatgaagtgatagaaaatggatatatcattgtagaaaatgatcaaattatagatgtgaagagcggagaattcgctaatgattttgaagtagatgaagtaattgacatgaaaggaaagtgggttttaccagggcttgtaaatacacatacacacgttgtaatgagtctcttaagaggtattggagatgatatgttattacaaccatggcttgagacgagaatttggccacttgaaagtcagtttactccagagcttgcggtcgctagtacggaattaggattacttgaaatggtaaaaagtggtacaacatcattctctgacatgtttaatccaattggagtagatcaagatgcaattatggaaacggtatcaagaagtgggatgcgagctgctgtttcaagaactttatttagcttcggaacgaaagatgatgaaaagaaagccattgaagaagctgaaaaatatgtaaagcgttactataacgaaagtggcatgttaactacgatggttgcaccgcatagtccatatacatgttccacagaattattagaagaatgcgcacgtattgcagtagaaaatcaaacgatggttcatattcatctttcggaaacagagcgtgaagtacgtgatattgaagcacagtacggaaaacgtccagtagaatatgcagcaagttgcgggttgtttaaacgcccaacagttattgcacacggtgtagtattaaatgaaaatgaacgtgcatttttagcagaacatgatgttcgagtagcacataatccgaatagtaatttaaaactaggatctggtatagcgaatgtaaaagcgatgctagaagcaggaatgaaagtaggaattgcaacagatagtgtggcatcaaacaacaatttagatatgtttgaagaaatgcgtatagcgactttactacaaaaaggtattcaccaagatgcaacagctttaccggttgaaactgctcttacacttgcgactaaaggagctgctgaagtaatcgggatgaaacaaacagggtcacttgaggttgggaagtgtgccgattttatcacaattgatccatctaataagccgcatttacaaccagcagatgaagtgttatcgcaccttgtatatgctgctagtggaaaagatataagcgatgtaatcattaacggaaaacgtgtcgtttggaatggagaatgtaaaacgttagatgaagagcgtattatatttgaagcgagtcgttataaacgaggtttgcaaagatag

SEQ ID NO: 78 - DNA, 1326 bp, Bacillus cereus
ttgaaaggggaaatacttttgaaaacaacttatgtaaacgctacaatcgtaacgatgaatgaacaaaatgaagtgatagaaaatggatatatcattgtagaaaatgatcaaattatagatgtaaagagcggagaattcgctaatgattttgcagtagatgaagtaattgacatgaaaggaaagtgggtattaccagggcttgtaaatacacatacacatgttgtaatgagtctcttaagaggtattggcgatgatatgttattacagccatggcttgagacgagaatttggccacttgaaagtcagtttactccagagcttgcagttgctagtacggaattaggattacttgaaatggtgaaaagtggtacaacatcattctctgacatgtttaatccaattggagtagatcaagatgcaattatggaaacggtatcaaggagtgggatgcgagctgctgtttcaagaactttatttagcttcggaacgaaagatgatgaaaagaaagcaatcgaagaagctgaaaaatatgtgaagcgttactataacgaaagtggtatgttaactacgatggttgcaccacatagcccatatacatgttctacagaattgttagaagaatgtgcacgtattgcagtagaaaatcaaacgatggttcatattcacctttcggaaacagagcgtgaagtacgtgatattgaagcacagtacggaaaacgtccagtagaatatgcagcaagttgcggattgtttaaacgtccaacagttattgcacacggtgtagtattaaatgaaaatgagcgtgcatttttagcagaacatgatgttcgagtagcacataacccgaatagtaatttaaaactaggttctggtatagcgaatgtaaaagcaatgttagaagcaggaatgaaagtaggaattgcaacagatagtgtggcctctaacaacaatttagatatgtttgaagaaatgcgcattgcaacattattacaaaaaggtattcatcaagatgcaacagcgttaccagttgaaacagctcttacacttgcgactaaaggagctgctgaagtaatcggcatgaaacaaacaggatcacttgaggttggaaagtgtgctgattttattacgattgacccatctaataagccgcatttacaaccagcagacgaagtattatcgcaccttgtatatgctgctagtggaaaagatattagcgatgttattattaacggaaaacgagtcgtttggaatggcgaatgtaaaacgttagatgaagagcgtattatatttgaagcgagtcgttataaacgaggtttacaaagatag

SEQ ID NO: 79 - DNA, 1308 bp, Bacillus cereus
ttgaaaacaacttatgtaaacgctacaattgtaacgatgaatgaacaaaacgaagtgatagaaaatggatatatcattgtagaaaatgatcaaattatagatgtaaagagcggagaatttgcaaatgattttgaagtagatgaagtaattgacatgaaaggaaagtgggttttaccagggcttgtaaatacacatacacacgttgtaatgagtctcctaagaggtattggagatgatatgttattacagccatggcttgagacgagaatttggccactggaaagtcagtttactccagagcttgcggttgctagtacggaattaggattacttgaaatggtgaaaagtggtacaacatcattctctgacatgtttaatccaattggagtagatcaagatgcaattatggaaacggtatcaaggagcgggatgcgagctgctgtttcaaggactttatttagcttcggaacgaaagacgatgaaaagaaagcgattgaagaagctgagaaatatgtgaagcgttattataaagaaagtggcatgttaactacgatggttgcaccacatagtccatatacatgtagtacagaactgttagaagagtgcgctcgtattgcagtagaaaatcaaacaatggttcatatccacctttctgaaacagagcgtgaagtacgtgatattgaagcacagtacggaaaacgtccagtagaatatgcagcgagctgcgggttgtttaaacgcccaacagttattgcacacggtgtagtattaaatgaaaatgaacgtgcatttttagcagaacatgacgttcgagtagcacataatccgaatagtaatttaaaactaggatctggtatagcgaatgtaaaagcgatgctagaagcaggaatgaaagtaggaattgcaacagatagtgtggcatcaaacaacaatttagatatgtttgaagaaatgcgtatagcgactttactacaaaaaggtattcaccaagatgcaacagctttaccggttgaaactgctcttacacttgcgactaaaggagctgctgaagtaatcgggatgaaacaaacaggatcacttgaggttggaaagtgtgctgattttattacgattgacccatctaataagccgcatttacaaccagcagatgaagtgttatcgcacctggtatatgcagctagtggaaaagatataagcgatgtaattattaacggaaagcgtgtcgtttggaatggcgaatgtaaaacgttagatgaagagcgtattatatttgaagcgagtcgttataaacgaggtttacaaagatag

SEQ ID NO: 80 - DNA, 1326 bp, Bacillus cereus
ttgaaaggggaaatacttttgaaaacaacttatgtaaacgctacaatcgtaacgatgaatgaacaaaacgaagtgatagaaaatggatatatcattgtagaaaatgatcaaattatagatgtaaagagcggagagttcgctaatgattttgaagtagatgaagtaattgacatgaaaggaaagtgggttttaccagggcttgtaaatacacatacacacgttgtaatgagtctcttaagaggtattggcgatgatatgttattacaaccatggctggagacgagaatttggccacttgaaagtcagtttactccagaacttgcggtcgctagtacggaattaggattacttgaaatggtgaaaagtggtacaacatcattctctgatatgtttaatccaattggagtagatcaagatgcaattatggaaacggtatcaaagagtggaatgcgagctgctgtttcaagaactttatttagcttcggaacgaaggacgatgagaagaaagcgattgaagaagctgaaaaatatgtgaagcgttactataacgaaagtggtatgttaactacgatggttgcgccgcatagtccatatacatgttctacagaactgttagaagagtgtgctcgtattgcagtagaaaatcaaacgatggttcatattcatctttcggaaacagagcgtgaagtacgtgatattgaaacacagtacggaaaacgtccagtagaatatgcagcaagttgcggtttatttaaacgcccaacagttattgcacacggtgtagtattaaatgaaaatgagcgtgcatttttagcagaacatgatgttcgagtagcacataacccgaatagtaatttaaaactaggatcgggtatagcgaatgtaaaagcgatgctagaagcaggaatgaaagttggaattgcaacagatagtgttgcatctaacaacaatttagatatgtttgaagaaatgcgtatagcaacattattacaaaaaggtattcatcaagatgcaacagcgttaccagttgaaacagcacttacacttgcaactaaaggagctgctgaagtaatcggcatgaaacaaacaggatcacttgaggttggaaagtgtgctgattttattacgattgatccgtctaataagccgcatttacaaccagcagatgaagtgttatcacaccttgtatatgctgctagtggaaaagatataagcgatgtaattattaacggaaaacgtgtcgtttggaatggcgaatgtaaaacgttagatgaagagcgtattatatttgaagcaagtcgttataaacgaggtttgcaaagatag

SEQ ID NO: 81 - DNA, 1308 bp, Bacillus cereus
ttgaaaacaacttatgtaaacgctacaattgtaacgatgaatgaacaaaacgaagtgatagaaaatggatatatcattgtagaaaatgatcaaattatagatgtaaaaagcggagaatttgctaataattttgaagtagatgaagtaattgacatgaaaggaaagtgggttttaccagggcttgtaaatacacatacacacgttgtaatgagtctcttaagaggtattggtgatgatatgttattacagccatggcttgagacaagaatttggccacttgaaagtcaatttactccagagcttgcggtcgctagtacggaattaggattacttgaaatggtgaaaagtggtacaacatcattctctgatatgtttaatccaattggagtagatcaagatgcaattatggaaacggtatcaaagagtggaatgcgagctgctgtttcaagaactttatttagcttcggaacgaaagatgatgaaaagaaagcaattgaagaagctgaaaaatatgtaaagcgttactataatgaaagtggtatgttaactacgatggttgcaccgcatagcccatatacatgttccacagaactattagaagaatgcgcacgtattgcagtagaaaatcaaacgatggttcatattcacctttcggaaacagagcgtgaagtacgtgatattgaagcgcagtatggaaaacgcccagtagaatatgcagcaagttgcgggctgtttaaacgcccaacagtcattgcgcacggtgtagtgttaaatgaaaatgagcgtgcatttttagcagaacacgatgttcgagtagctcataatccgaatagtaatttaaaactaggatcgggtatagcgaatgtaaaagcgatgctagaagcaggaatgaaagttggaattgcaacagatagtgttgcatctaacaacaatttagatatgtttgaagaaatgcgtatagcaacattattacaaaaaggtattcatcaagatgcaacagcgttaccagttgaaacagcacttacacttgcaactaaaggagctgctgaagtaatcggcatgaaacaaacaggatcacttgaggttggaaagtgtgctgattttattacgattgatccgtctaataagccgcatttacaaccagcagatgaagtgttatcacaccttgtatatgctgctagtggaaaagatataagcgatgtaattattaacggaaaacgtgtcgtttggaatggcgaatgtaaaacgttagatgaagagcgtattatatttgaagcaagtcgttataaacgaggtttgcaaagatag

SEQ ID NO: 82 - DNA, 1326 bp, Bacillus cereus
ttgaaaggggaaatacttttgaaaacaacttatgtaaacgctacaattgtaacgatgaatgaacaaaacgaagtgatagaaaatggatatatcattgtagaaaatgatcaaattatagatgtaaaaagcggagaatttgctaataattttgaagtagatgaagtaattgacatgaaaggaaagtgggttttaccagggcttgtaaatacacatacacacgttgtaatgagtctcttaagaggtattggtgatgatatgttattacagccatggcttgagacaagaatttggccacttgaaagtcaatttactccagagcttgcggtcgctagtacggaattaggattacttgaaatggtgaaaagtggtacaacatcattctctgatatgtttaatccaattggagtagatcaagatgcaattatggaaacggtatcaaagagtggaatgcgagctgctgtttcaagaactttatttagcttcggaacgaaagatgatgaaaagaaagcaattgaagaagctgaaaaatatgtaaagcgttactataatgaaagtggtatgttaactacgatggttgcaccgcatagcccatatacatgttccacagaactattagaagaatgcgcacgtattgcagtagaaaatcaaacgatggttcatattcacctttcggaaacagagcgtgaagtacgtgatattgaagcgcagtatggaaaacgcccagtagaatatgcagcaagttgcgggctgtttaaacgcccaacagtcattgcgcacggtgtagtgttaaatgaaaatgagcgtgcatttttagcagaacacgatgttcgagtagctcataatccgaatagtaatttaaaactaggatcgggtatagcgaatgtaaaagcgatgctagaagcaggaatgaaagttggaattgcaacagatagtgttgcatctaacaacaatttagatatgtttgaagaaatgcgtatagcaacattattacaaaaaggtattcatcaagatgcaacagcgttaccagttgaaacagcacttacacttgcaactaaaggagctgctgaagtaatcggcatgaaacaaacaggatcacttgaggttggaaagtgtgctgattttattacgattgatccgtctaataagccgcatttacaaccagcagatgaagtgttatcacaccttgtatatgctgctagtggaaaagatataagcgatgtaattattaacggaaaacgtgtcgtttggaatggcgaatgtaaaacgttagatgaagagcgtattatatttgaagcaagtcgttataaacgaggtttgcaaagatag

SEQ ID NO: 83 - DNA, 1308 bp, Bacillus cereus
ttgaaaacaacttatgtaaacgctacaatagtaacgatgaatgaacaaaatgaagtgatagaaaatggatatatcattgtagaaaatgatcaaattatagatgtgaagagcggagaattcgctaatgattttgaagtagatgaagtaattgacatgaaaggaaagtgggttttaccagggcttgtcaatacacatacacacgttgtaatgagtctcttaagaggtattggtgatgatatgttattacaaccatggcttgagacgagaatttggccacttgaaagtcaatttactccagaacttgcggttgctagtacggaactaggattacttgaaatggtgaaaagtggtacaacatcattctctgatatgtttaatccaattggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataacgaaagtggtatgttaactacgatggttgcaccgcatagtccatatacatgcagtacagaactgttagaagagtgtgcacgtattgcagtagaaaatcaaacgatggttcatattcacctttcggaaacagagcgtgaagtacgtgatattgaagcacagtacggaaaacgtccagtagaatatgcagcaagttgcggattgtttaaacgaccgacagttattgcacacggtgtagtattaaatgacaatgagcgtgcatttttagcagaacatgacgttcgagtagctcataatccgaatagtaatttaaaactaggttctggtatagcgaatgtaaaagcgatgctagaagcgggaatgaaagtaggaattgcaacagatagtgttgcatctaacaacaatttagatatgtttgaggaaatgcgcattgcaactttattacaaaaaggtattcaccaagacgcaacagcgttaccggttgaaacagctcttacacttgcaactaagggagctgctgaagtaattgggatgaaacaaacaggctcacttgagattggaaagtgtgctgatttcattacaattgacccgtctaataagccgcatttacaaccagcagatgaagtgttatcacaccttgtgtatgctgctagtggaaaagatataagcgatgtaattattaacggaaaacgtgtcgtttggaatggcgaatgtaaaacgttagatgaagagcgtattatatttgaagcaagtcgatataaacgaggtttgcaaagatag

SEQ ID NO: 84 - DNA, 1326 bp, Bacillus cereus
ttgaaaggggaaatacttttgaaaacaacttatgtaaacgctacaattgtaacgatgaatgaacaaaatgaagtgatagaaaatggatatatcattgtagaaaatgatcaaattatagatgtgaagagcggagaattcgctaatgattttgaagtagatgaagtaattgacatgaaaggaaagtgggttttaccagggcttgtcaatacacatacacacgttgtaatgagtctcttaagaggtattggtgatgatatgttattacaaccatggcttgagacgagaatttggccacttgaaagtcaatttactccagaacttgcggttgctagtacggaactaggattacttgaaatggtgaaaagtggtacaacatcattctctgatatgtttaatccaattggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataacgaaagtggtatgttaactacgatggttgcaccgcatagtccatatacatgcagtacagaactgttagaagagtgtgcacgtattgcagtagaaaatcaaacgatggttcatattcacctttcggaaacagagcgtgaagtacgtgatattgaagcacagtacggaaaacgtccagtagaatatgcagcaagttgcggattgtttaaacgaccgacagttattgcacacggtgtagtattaaatgacaatgagcgtgcatttttagcagaacatgacgttcgagtagctcataatccgaatagtaatttaaaactaggttctggtatagcgaatgtaaaagcgatgctagaagcgggaatgaaagtaggaattgcaacagatagtgttgcatctaacaacaatttagatatgtttgaggaaatgcgcattgcaactttattacaaaaaggtattcaccaagacgcaacagcgttaccggttgaaacagctcttacacttgcaactaagggagctgctgaagtaattgggatgaaacaaacaggctcacttgagattggaaagtgtgctgatttcattacaattgacccgtctaataagccgcatttacaaccagcagatgaagtgttatcacaccttgtgtatgctgctagtggaaaagatataagcgatgtaattattaacggaaaacgtgtcgtttggaatggcgaatgtaaaacgttagatgaagagcgtattatatttgaagcaagtcgatataaacgaggtttgcaaagatag

SEQ ID NO: 85 - DNA, 1308 bp, Bacillus cereus
ttgaaaacaacttatgtaaacgctacaatcgtaacgatgaatgaacaaaacgaagtgatagaaaatggatatatcattgtagaaaatgatcaaattatagatgtaaagagcggagaattcgctaatgattttgcagtagatgaagtaattgacatgaaaggaaagtgggttttaccagggcttgtaaatacacatacacacgttgtaatgagtctcttaagaggtattggcgatgatatgttattacaaccgtggcttgagacgagaatttggccacttgaaagtcagtttacgccagagcttgcggttgctagtacggaattaggattacttgaaatggtgaaaagtggtacaacatcattctctgacatgtttaatccaattggagtagatcaagatgcaattatggaaacggtatcaaggagtggaatgcgagctgctgtttcaagaactttatttagcttcggaacgaaagacgatgaaaagaaagcaattgaggaagctgagaaatatgtgaagcgctactataacgaaagtggtatgttaactacgatggttgcaccgcatagtccatatacatgtagtgcagaactgttagaagaatgcgcacgtattgcagtagaaaatcaaacgatggttcatattcatctttcagaaacagagcgtgaagtacgtgatattgaagcacagtacggaaaacgtccagtagaatatgcagcaagttgcgggttgtttaaacgcccaacagttattgcacacggtgtagtattaaatgaaaatgagcgtgcatttttagcagaacatgatgttcgagtagcacataacccaaatagtaatttaaaactaggttctggtatagcgaatgtaaaagcgatgctagaagcaggaatgaaagtaggaattgcaacagatagtgtggcctctaacaacaatttagatatgtttgaagaaatgcgtatagcaacattattacaaaaaggcattcatcaagatgcaacagcgttaccagttgaaacagctcttacacttgcgactaaaggagctgctgaagtaatcggcatgaaacaaacaggatcacttgaggttggaaagtgtgctgattttattacaattgacccatctaataagccgcatttacaaccagcagacgaagtattatcgcaccttgtatatgctgctagtggaaaagatattagcgatgttattattaacggaaaacgtgtcgtttggaatggcgaatgtaaaacgttagatgaagagcgtattatatttgaagcgagtcgttataaacgaggtttgcaaagatag

SEQ ID NO: 86 - DNA, 1308 bp, Bacillus mycoides
ttgaaaacaacttatgtaaacgctacaattgcaacgatgaatgaacaaaatgaagtgatagaaaatggatatatcattgtagaaaatgatcaaattatagatgtaaatagcggagaattcgctaacgattttgaagtagatgaagtaattgacatgaaaggaaagtgggttttaccagggcttgtcaatacacatacacatgttgttatgagccttttgagaggtatcggagatgatatgttattgcagccatggcttgagacgagaatttggccacttgaaagtcagtttacgccagagcttgcggtcgctagcacggaattaggattacttgaaatggtgaaaagtggtacaacatcattctctgatatgtttaatcctattggagtagaccaagatgcaattatggaaacggtatcaaggagtggaatgcgtgctgctgtttcaagaactttatttagcttcggaacgaaagacgatgaaaagaaagcaattgaagaagctgagaaatatgtgaagcgttactataacgaaagtggtatgttaactacgatggttgcaccgcatagtccatatacatgttccacagaactgttagaagagtgtgctcgtattgcagtagaaaatcaaacgatggttcatattcatctttctgaaacagagcgtgaagtacgtgatattgaagcacagtatgggaagcgtccagtagaatatgcagcaagttgcggattgtttaaacgcccaacagttattgcgcacggtgtagtattaaatgaaaatgagcgtgcatttttagcagaacatgatgttcgagtagctcataacccaaatagtaatttaaaactaggttctggtatagcgaatgtaaaagcgatgctagaagcaggaataaaagtaggaattgcaacagatagtgtggcgtctaacaacaatttagatatgtttgaagaaatgcgcattgcaacattattacaaaaaggtattcatcaagatgcaacagcgttaccagttgaaacagctcttacacttgcgactaaaggagctgctgaagtaatcgggatgaaacaaacgggctcacttgaggtcggaaagtgtgctgattttattacgattgacccatctaataagccgcatttacaaccggcagatgaagtgttatcacatcttgtgtatgcagctagtggaaaagatataagcgatgtaattattaatggtaaacgtgtcgtttggaatggtgaatgtaaaacgttagatgaagagcgtattatatttgaagcaagtcgttataaacgaggtttacaaagatag

SEQ ID NO: 87 - DNA, 1308 bp, Bacillus weihenstephanensis
ttgaaaacaacttatgtaaacgctacaattgcaacgatgaatgaacaaaatgaagtgatagaaaatggatatatcattgtagaaaatgatcaaattatagatataaatagcggagaattcgctaacgattttgaagtagatgaagtaattgacatgaaaggaaagtgggttttaccagggcttgtcaatacacatacacatgttgttatgagccttttgagaggtatcggagatgatatgttattgcagccatggcttgagacgagaatttggccacttgaaagtcagtttacgccagagcttgcggtcgctagcacggaattaggattacttgaaatggtgaaaagtggtacaacatcattctctgatatgtttaatcctattggagtagaccaagatgcaattatggaaacggtatcaaggagtggaatgcgtgctgctgtttcaagaactttatttagcttcggaacgaaagacgatgaaaagaaagcaattgaagaagctgagaaatatgtgaagcgttactataacgaaagtggtatgttaactacgatggttgcaccacatagtccatatacatgttccacagaactgttagaagagtgtgctcgtattgcagtagaaaatcaaacgatggttcatattcatctttctgaaacagagcgtgaagtacgtgatattgaagcacagtatgggaagcgtccagtagaatatgcagcaagttgcggattgtttaaacgcccaacagttattgcacacggtgtagtattaaatgaaaatgagcgtgcatttttagcagaacatgatgttcgagtagctcataacccaaatagtaatttaaaactaggttctggtatagcgaatgtaaaagcgatgctagaagcaggaataaaagtaggaattgcaacagatagtgtggcgtctaacaacaatttagatatgtttgaagaaatgcgcattgcaacattattacaaaaaggtattcatcaagatgcaacagcgttaccagttgaaacagctcttacacttgcgactaaaggagctgctgaagtaatcgggatgaaacaaacgggctcacttgaggttggaaagtgtgctgattttattacgattgacccatctaataagccgcatttacaaccggcagatgaagtgttatcacatcttgtgtatgcagctagtggaaaagatataagcgatgtaattattaatggtaaacgtgtcgtttggaatggtgaatgtaaaacattagatgaagagcgtattatatttgaagcaagtcgttataaacgaggtttacaaagatag

SEQ ID NO: 88 - DNA, 1308 bp, Bacillus cereus
ttgaaaacaacttatgtaaacgctacaatcgtaacgatgaatgaacaaaacgaagtgatagaaaatggatatatcattgtagaaaatgatcaaattatagatgtaaagagcggagaattcgctaatgattttgcagtagatgaagtaattgacatgaaaggaaagtgggttttaccagggcttgtaaatacacatacacacgttgtaatgagtctcttaagaggtattggcgatgatatgttattacaaccgtggcttgagacgagaatttggccacttgaaagtcagtttactccagagcttgcggttgctagtacggaattaggattacttgaaatggtgaaaagtggtacaacatcattctctgacatgtttaatccaattggagtagatcaagatgcaattatggaaacggtatcaaggagcgggatgcgagctgctgtttcaagaactttatttagcttcggaacgaaagacgatgaaaagaaagcaatcgaagaagctgagaaatatgtgaagcgctactataacgaaagtggcatgttaactacgatggttgcaccgcatagtccatatacatgttctacagaactgttagaagagtgcgctcgtattgcagtagaaaatcaaacgatggttcatattcatctttcggaaacagagcgtgaagtacgtgatattgaagcacagtacgggaaacgtccagtagaatatgcagcaagttgcgggttatttaaacgcccaacagttattgcacacggtgtagtattaaatgaaaatgagcgtgcatttttagcagaacatgatgttcgagtagcacataacccaaatagtaatttaaaactaggttctggtatagcgaatgtaaaagcgatgctagaagcaggaatgaaagtaggaattgcaacagatagtgtggcctctaacaacaatttagatatgtttgaagaaatgcgtatagcaacattattacaaaaaggcattcatcaagatgcaacagcgttaccagttgaaacagctcttacacttgcgactaaaggagctgctgaagtaattggtatgaaacaaacaggatcacttgaggttggaaagtgtgctgattttattacgattgacccatctaataagccgcatttacaaccagcagacgaagtattatcgcaccttgtatatgctgctagtggaaaagatattagcgatgtaattattaacggaaaacgtgtcgtttggaatggcgaatgtaaaacgttagatgaagagcgtattatatttgaagcgggtcgttataaacgaggtttacaaagatag

SEQ ID NO: 89 - DNA, 1326 bp, Bacillus thuringiensis
ttgaaaggggaaatacttttgaaaacaacttatgtaaacgctacaatcgtaacgatgaatgaacaaaatgaagtgatagaaaatggatatatcattgtagaaaatgatcaaattatagatgtgaagagcggagaattcactaatgattttgaagtagatgaagtaattgacatgaaaggaaagtgggttttaccagggcttgtaaatacacatacacacgttgtaatgagtctcttaagaggtattggtgatgatatgttattacaaccatggcttgagacgagaatttggccacttgaaagtcagtttactccagagcttgcggtcgctagtacggaattaggattacttgaaatggtgaaaagtggcacaacatcattctctgatatgtttaatccaatcggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataatgaaagtggtatgttaactacgatggttgcaccgcatagtccatatacatgttccacagaactattagaagaatgcgcacgtattgcagtagaaaatcaaacgatggttcatattcacctttcggaaacagagcgtgaagtacgtgatattgaagcacagtacggaaaacgtccagtagaatatgcagcaagttgtgggttatttaaacgcccaacagttattgcacacggtgtagtattaaatgaaaatgagcgtgcatttttagcagaacatgacgttcgagtagcacataacccgaatagtaatttaaaactaggttctggtatagcgaatgtaaaagcgatgctagaagcgggaatgaaagtaggaattgcaacagatagtgtggcatctaacaacaatttagatatgtttgaggaaatgcgcattgcaactttattacaaaaaggtattcaccaagacgcaacagcgttaccggttgaaacagctcttacacttgcaactaagggggctgctgaagtaattgggatgaaacaaacaggctcacttgagattggaaagtgtgctgattttattacaattgacccgtctaataaaccgcatttacaaccagcagatgaagtgttatcacaccttgtatatgctgcaagtggaaaagatataagcgatgtaattattaacggaaaacgtgtcgtttggaatggcgaatgtaaaacattagatgaagagcgtattatatttgaagcaagtcgatataaacgtggtttgcaaagatag

SEQ ID NO: 90 - DNA, 1326 bp, Bacillus mycoides
ttgaaaggggaaatacttttgaaaacaacttatgtaaacgctacaattgcaacgatgaatgaacaaaatgaagtgatagaaaatggatatatcattgtagaaaatgatcaaattatagatataaatagcggagaattcgctaacgattttgaagtagatgaagtaattgacatgaaaggaaagtgggttttaccagggcttgtcaatacacatacacatgttgttatgagccttttgagaggtatcggagatgatatgttattgcagccatggcttgagacgagaatttggccacttgaaagtcagtttacgccagagcttgcggtcgctagcacggaattaggattacttgaaatggtgaaaagtggtacaacatcattctctgatatgtttaatcctattggagtagaccaagatgcaattatggaaacggtatcaaggagtggaatgcgtgctgctgtttcaagaactttatttagcttcggaacgaaagacgatgaaaagaaagcaattgaagaagctgagaaatatgtgaagcgttactataacgaaagtggtatgttaactacgatggttgcaccacatagtccatatacatgttccacagaactgttagaagagtgtgctcgtattgcagtagaaaatcaaacgatggttcatattcatctttctgaaacagagcgtgaagtacgtgatattgaagcacagtatgggaagcgtccagtagaatatgcagcaagttgcggattgtttaaacgcccaacagttattgcacacggtgtagtattaaatgaaaatgagcgtgcatttttagcagaacatgatgttcgagtagctcataacccaaatagtaatttaaaactaggttctggtatagcgaatgtaaaagcgatgctagaagcaggaataaaagtaggaattgcaacagatagtgtggcgtctaacaacaatttagatatgtttgaagaaatgcgcattgcaacattattacaaaaaggtattcatcaagatgcaacagcgttaccagttgaaacagctcttacacttgcgactaaaggagctgctgaagtaatcgggatgaaacaaacgggctcacttgaggttggaaagtgtgctgattttattacgattgacccatctaataagccgcatttacaaccggcagatgaagtgttatcacatcttgtgtatgcagctagtggaaaagatataagcgatgtaattattaatggtaaacgtgtcgtttggaatggtgaatgtaaaacattagatgaagagcgtattatatttgaagcaagtcgttataaacgaggtttacaaagatag

SEQ ID NO: 91 - DNA, 1308 bp, Bacillus cereus
ttgaaaacaacttatgtaaacgctacaatcgtaacgatgaatgaacaaaatgaagtgatagaaaatggatatatcattgtagaaaatgatcaaattatagatgtaaagagcggagaactcgctaatgattttgaagtagatgaagtaattgatatgaaaggaaagtgggttttaccagggcttgtaaatacacatacacatgttgtaatgagtctcttaagaggtattggcgatgatatgttattacagccatggcttgagacgagaatttggccacttgaaagtcagtttacgccagagcttgcggtcgctagcacggaattaggattacttgaaatggtgaaaagtggtacaacatcattctctgatatgtttaatccaattggagtagatcaagatgcaattatggaaacggtatcaaagagtggaattcgagctgcagtttcaagaactttatttagcttcggaacgaaagacgatgaaaagaaagcaattgaagaagctgaaaaatatgtgaagcgttactataatgaaagtggtatgttaactacgatggttgcaccgcatagtccatatacatgttccacagaactgttagaagaatgcgcacgaattgcagtagaaaatcaaacgatggttcatattcatctttcggaaacagagcgtgaagtacgtgatattgaagcacagtacggaaaacgtccagtagaatatgcagcaagttgcgggttgtttaaacgcccaacagttattgcacacggtgtagtattaaatgaaaatgaacgtgcatttttagcagaacatgatgttcgagtagctcataacccgaatagtaatttaaaactaggatctggtatagcgaatgtaaaagcaatgttagaagcaggaatgaaagtaggaattgcaacagatagtgtggcatctaacaacaatttagatatgtttgaagaaatgcgtatagcaacattattacaaaaaggcattcatcaagatgcaacagcactaccagttgaaacagctcttacacttgcgactaaaggagctgctgaagtaatcggcatgaaacaaacaggatcacttgaggtcggaaagtgtgccgattttatcacaattgatccatctaataagccgcatttacaaccagcagatgaagtgttatcgcaccttgtatatgctgctagtggaaaagatataagcgatgtaattattaacggaaaacgtgtcgtttggaatggcgaatgtaaaacgttagatgaagagcgtattatatttgaagcgagtcgttataaacgagggttgcaaagatag

SEQ ID NO: 92 - DNA, 1308 bp, Bacillus mycoides
ttgaaaacaacttatgtaaacgctacaattgcaacgatgaatgaacaaaatgaagtgatagaaaatggatatatcattgtagaaaatgatcaaattatagatgtaaatagcggagaattcgctaacgattttgaagtagatgaagtaattgacatgaaaggaaagtgggttttaccagggcttgtcaatacacatacacatgttgttatgagccttttgagaggtatcggagatgatatgttattgcagccatggcttgagacgagaatttggccacttgaaagtcagtttacgccagagcttgcggtcgctagcacggaattaggattacttgaaatggtgaaaagtggtacaacatcattctctgatatgtttaatcctattggagtagaccaagatgcaattatggaaacggtatcaaggagtggaatgcgtgctgctgtttcaagaactttatttagcttcggaacgaaagacgatgaaaagaaagcaattgaagaagctgagaaatatgtgaagcgttactataacgaaagtggtatgttaactacgatggttgcaccgcatagtccatatacatgttccacagaactgttagaagagtgtgctcgtattgcagtagaaaatcaaacgatggttcatattcatctttctgaaacagagcgtgaagtacgtgatattgaagcacagtatgggaagcgtccagtagaatatgcagcaagttgcggattgtttaaacgcccaacagttattgcgcacggtgtagtattaaatgaaaatgagcgtgcatttttagcagaacatgatgttcgagtagctcataacccaaatagtaatttaaaactaggttctggtatagcgaatgtaaaagcgatgctagaagcaggaataaaagtaggaattgcaacagatagtgtggcgtctaacaacaatttagatatgtttgaagaaatgcgtatagcgactttattacaaaaaggtattcatcaagatgcaacagcattaccagttgaaacagctctttctcttgcgacaaaaggagctgcggaagtaattggtatgaaacaaacgggatcacttgaggttggtaagtgtgctgattttattacgattgatccatctaataagccacatttacaaccggcagatgaagtgttatcacatcttgtgtatgcagctagtggaaaagatataagcgatgtaattattaatggtaaacgtgtcgtttggaatggtgaatgtaaaacgttagatgaagagcgtattatatttgaagcaagtcgttataaacgaggtttacaaagatag

SEQ ID NO: 93 - DNA, 1308 bp, Bacillus thuringiensis
ttgaaaacaacttatgtaaacgctacaattgtaacgatgaatgaacaaaacgaagtgatagaaaatggatatatcattgtagaaaatgatcaaattatagatgtaaagagcggagaattcgctaatgattttgcagtagatgaagtaattgacatgaaaggaaagtgggttttaccagggcttgtaaatacacatacacacgttgtaatgagtctcttaagaggtattggcgatgatatgttattacaaccatggctggagacgagaatttggccacttgaaagtcagtttactccagagcttgcggttgctagtacggaattaggattacttgaaatggtgaaaagtggtacaacatcattctctgacatgtttaatccaattggagtagatcaagatgcaattatggaaacggtatcaaagagtgggatgcgagctgctgtttcaagaactttatttagcttcggaacgaaagacgatgaaaagaaagcaatcgaagaagctgagaaatatgtgaagcgttactataacgaaagtggcatgttaactacgatggttgcaccgcatagtccatatacatgtagtgcagaactgttagaagagtgcgctcgtattgcagtagaaaatcaaacgatggttcatattcatctttcggaaacagagcgtgaagtacgtgatattgaagcgcagtacgggaaacgtccagtagaatatgcagcaagttgcgggttgtttaaacgcccaacagttattgcacacggtgtagtattaaatgaaaatgagcgtgcatttttagcagaacatgatgttcgagtagcacataacccaaatagtaatttaaaactaggttctggtatagcaaatgtaaaagcgatgctagaggcaggaatgaaagtaggaattgcaacagatagtgtggcatctaacaacaatttagatatgtttgaagaaatgcgcatagcgactttactacaaaaaggtattcaccaagatgcaacagcgttaccagttgaaacagctcttacacttgcgactaaaggagctgctgaagtaatcgggatgaaacaaacaggatcacttgaggttggaaagtgtgctgattttattacgattgacccatctaataagccgcatttacaaccagcagatgaagtgttatcgcacctggtatatgcagctagtggaaaagatataagcgatgtaattattaacggaaagcgtgtcgtttggaatggcgaatgtaaaacgttagatgaagagcgtattatatttgaagcgagtcgttataaacgaggtttacaaagatag

SEQ ID NO: 94 - DNA, 1308 bp, Bacillus cereus
ttgaaaacaacttatgtaaacgctacaattgtaacgatgaatgaacaaaacgaagtgatagaaaatggatatatcattgtagaaaatgatcaaattatagatgtaaaaagcggagaatttgctaataattttgaagtagatgaagtaattgacatgaaaggaaagtgggttttaccagggcttgtaaatacacatacacacgttgtaatgagtctcttaagaggtattggtgatgatatgttattacagccatggcttgagacaagaatttggccacttgaaagtcaatttactccagagcttgcggtcgctagtacggaattaggattacttgaaatggtgaaaagtggtacaacatcattctctgatatgtttaatccaattggagtagatcaagatgtaattatggaaacggtatcaaagagtggaatgcgagctgctgtttcaagaactttatttagcttcggaacgaaagatgatgaaaagaaagcaattgaagaagctgaaaaatatgtaaagcgttactataatgaaagtggtatgttaactacgatggttgcaccgcatagcccatatacatgttccacagaactattagaagaatgcgcacgtattgcagtagaaaatcaaacgatggttcatattcacctttcggaaacagagcgtgaagtacgtgatattgaagcgcagtatggaaaacgcccagtagaatatgcagcaagttgcgggctgtttaaacgcccaacagtcattgcgcacggtgtagtgttaaatgaaaatgagcgtgcatttttagcagaacacgatgttcgagtagctcataatccgaatagtaatttaaaactaggatcgggtatagcgaatgtaaaagcgatgctagaagcaggaatgaaagttggaattgcaacagatagtgttgcatctaacaacaatttagatatgtttgaagaaatgcgtatagcaacattattacaaaaaggtattcatcaagatgcaacagcgttaccagttgaaacagcacttacacttgcaactaaaggagctgctgaagtaatcggcatgaaacaaacaggatcacttgaggttggaaagtgtgctgattttattacgattgatccgtctaataagccgcatttacaaccagcagatgaagtgttatcacaccttgtatatgctgctagtggaaaagatataagcgatgtaattattaacggaaaacgtgtcgtttggaatggcgaatgtaaaacgttagatgaagagcgtattatatttgaagcaagtcgttataaacgaggtttgcaaagatag

SEQ ID NO: 95 - DNA, 1308 bp, Bacillus cereus
ttgaaaacaacttatgtaaacgctacaatcgtaacgatgaatgaacaaaatgaagtgatagaaaatggatatatcattgtagaaaatgatcaaattatagatgtgaagagcggagaattcgctactgattttgaagtagatgaagtaattgacatgaaaggaaagtgggttttaccagggcttgtaaatacacatacacacgttgtaatgagtctcttaagaggtattggcgatgatatgttattacaaccatggcttgagacgagaatttggccacttgaaagtcaatttactccagaacttgcggttgctagtacggaactaggattacttgaaatggtgaaaagtggtacaacatcattctctgatatgtttaatccaattggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataacgaaagtggtatgttaactacgatggttgcaccgcatagtccatatacatgcagtacagaactgttagaagagtgtgcacgtattgcagtagaaaatcaaacgatggttcatattcacctttcggaaacagagcgtgaagtacgtgatattgaagcacagtacggaaaacgtccagtagaatatgcagcaagttgcggattgtttaaacgaccgacagttattgcacacggtgtagtattaaatgacaatgagcgtgcatttttagcagaacatgacgttcgagtagctcataatccgaatagtaatttaaaactaggttctggtatagcgaatgtaaaagcgatgctagaagcgggaatgaaagtaggaattgcaacagatagtgttgcatctaacaacaatttagatatgtttgaggaaatgcgcattgcaactttattacaaaaagggattcaccaagacgcaacagcgttaccggttgaaacagctcttacacttgcgactaagggagctgctgaagtaattgggatgaaacaaacaggctcacttgagattggaaagtgtgctgatttcattacaattgacccgtctaataagccgcatttacaaccagcagatgaagtgttatcacaccttgtgtatgctgctagtggaaaagatataagcgatgtaattattaacggaaaacgtgtcgtttggaatggcgaatgtaaaacgttagatgaagagcgtattatatttgaagcaagtcgatataaacgaggtttgcaaagatag

SEQ ID NO: 96 - DNA, 1326 bp, Bacillus cereus
ttgaaaggggaaatacttttgaaaacaacttatgtaaacgctacaattgcaacgatgaatgaacaaaatgaagtgatagaaaatggatatatcattgtagaaaatgatcaaattatagatataaatagcggagaattcgctaacgattttgaagtagatgaagtaattgacatgaaaggaaagtgggttttacctgggcttgtcaatacacatacacatgttgttatgagccttttgagaggtatcggagatgatatgttattgcagccatggcttgagacgagaatttggccacttgaaagtcagtttacgccagagcttgcggtcgctagcacggaattaggattacttgaaatggtgaaaagtggtacaacatcattctctgatatgtttaatcctattggagtagaccaagatgcaattatggaaacggtatcaaggagtggaatgcgtgctgctgtttcaagaactttatttagcttcggaacgaaagacgatgaaaagaaagcaattgaagaagctgagaaatatgtgaagcgttactataacgaaagtggtatgttaactacgatggttgcaccacatagtccatatacatgttccacagaactgttagaagagtgtgctcgtattgcagtagaaaatcaaacgatggttcatattcatctttctgaaacagagcgtgaagtacgtgatattgaagcacagtatgggaagcgtccagtagaatatgcagcaagttgcggattgtttaaacgcccaacagttattgcacacggtgtagtattaaataaaaatgagcgtgcatttttagcagaacatgatgttcgagtagctcataacccaaatagtaatttaaaactaggttctggtatagcgaatgtaaaagcgatgctagaagcaggaataaaagtaggaattgcaacagatagtgtggcgtctaacaacaatttagatatgtttgaagaaatgcgcattgcaacattattacaaaaaggtattcatcaagatgcaacagcgttaccagttgaaacagctcttacacttgcgactaaaggagctgctgaagtaatcgggatgaaacaaacgggctcacttgaggttggaaagtgtgctgattttattacgattgacccatctaataagccgcatttacaaccggcagatgaagtgttatcacatcttgtgtatgcagctagtggaaaagatataagcgatgtaattattaatggtaaacgtgtcgtttggaatggtgaatgtaaaacattagatgaagagcgtattatatttgaagcaagtcgttataaacgaggtttacaaagatag

SEQ ID NO: 97 - DNA, 1326 bp, Bacillus thuringiensis
ttgaaaggggaaatacttttgaaaacaacttatgtaaacgctacaattgtaacgatgaatgaacaaaacgaagtgatagaaaatggatatatcattgtagaaaatgatcaaattatagatgtaaagagcggagaattcgctaatgattttgcagtagatgaagtaattgacatgaaaggaaagtgggttttaccagggcttgtaaatacacatacacacgttgtaatgagtctcttaagaggtattggcgatgatatgttattacaaccatggctggagacgagaatttggccacttgaaagtcagtttactccagagcttgcggttgctagtacggaattaggattacttgaaatggtgaaaagtggtacaacatcattctctgacatgtttaatccaattggagtagatcaagatgcaattatggaaacggtatcaaagagtgggatgcgagctgctgtttcaagaactttatttagcttcggaacgaaagacgatgaaaagaaagcaatcgaagaagctgagaaatatgtgaagcgttactataacgaaagtggcatgttaactacgatggttgcaccgcatagtccatatacatgtagtgcagaactgttagaagagtgcgctcgtattgcagtagaaaatcaaacgatggttcatattcatctttcggaaacagagcgtgaagtacgtgatattgaagcgcagtacgggaaacgtccagtagaatatgcagcaagttgcgggttgtttaaacgcccaacagttattgcacacggtgtagtattaaatgaaaatgagcgtgcatttttagcagaacatgatgttcgagtagcacataacccaaatagtaatttaaaactaggttctggtatagcaaatgtaaaagcgatgctagaggcaggaatgaaagtaggaattgcaacagatagtgtggcatctaacaacaatttagatatgtttgaagaaatgcgcatagcgactttactacaaaaaggtattcaccaagatgcaacagcgttaccagttgaaacagctcttacacttgcgactaaaggagctgctgaagtaatcgggatgaaacaaacaggatcacttgaggttggaaagtgtgctgattttattacgattgacccatctaataagccgcatttacaaccagcagatgaagtgttatcgcacctggtatatgcagctagtggaaaagatataagcgatgtaattattaacggaaagcgtgtcgtttggaatggcgaatgtaaaacgttagatgaagagcgtattatatttgaagcgagtcgttataaacgaggtttacaaagatag

SEQ ID NO: 98 - DNA, 1326 bp, Streptococcus pneumoniae
ttgaaaggggaaatacttttgaaaacaacttatgtaaacgctacaatcgtaacgatgaatgaacaaaatgaagtgatagaaaatggatatatcattgtagaaaatgatcaaattatagatgtgaagagcggagaattcgctaatgattttgaagtagatgaagtaattgacatgaaaggaaaatgggttttaccagggcttgtcaatacacatacacacgttgtaatgagtctcttaagaggtattggtgatgatatgttattacagccgtggcttgagacaagaatttggccacttgaaagtcaatttactccagaacttgcggttgctagtacggaactaggattacttgaaatggtgaaaagtggtacaacatcattctctgatatgtttaatccaattggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataacgaaagtggtatgttaactacgatggttgcaccgcatagtccatatacatgcagtacagaactgttagaagagtgtgcacgtattgcagtagaaaatcaaacgatggttcatattcacctttcggaaacagagcgtgaagtacgtgatattgaagcaaagtacggaaaacgtccagtagaatatgcagcaagttgcggattgtttaaacgaccgacagttattgcacacggtgtagtattaaatgacaatgagcgtgcatttttagcggaacatgacgttcgagtagctcataatccgaatagtaatttaaaactagggtctggtatagcgaatgtaaaagcgatgctagaagcaggaataaaagtaggaattgcaacagatagtgtggcatctaacaataatttagatatgtttgaagaaatgcgcatagcgactttactacaaaaaggtattcaccaagatgcaacagcgttaccggttgaaacagctcttacacttgcgacaaaaggagctgcggaagtaatcggtatgaaacaaacaggatcacttgaggttggaaagtgtgcggattttattacgattgacccgtctaataagccgcatttacaaccagcggatgaagtgctatcacaccttgtatatgctgctagtggaaaagatataagtgatgtaatcattaacggaaaacgtgtcgtttggaatggcgaatgtaaaacgttagatgaagagcgtattatatttgaagcaagtcgatataaacgaggtttgcaaagataa

SEQ ID NO: 99 - DNA, 1326 bp, Bacillus cereus
ttgaaaggggaaatacttttgaaaacaacttatgtaaacgctacaattgcaacgatgaatgaacaaaatgaagtgatagaaaatggatatatcattgtagaaaatgatcaaattatagatataaatagcggagaattcgctaacgattttgaagtagatgaagtaattgacatgaaaggaaagtgggttttaccagggcttgtcaatacacatacacatgttgtaatgagtctcttaagaggtattggcgatgatatgttattgcagccatggcttgagacgagaatttggccacttgaaagtcagtttacgccagagcttgcggtcgctagcacggaattaggattacttgaaatggtgaaaagtggtacaacatcattctctgatatgtttaatcctattggagtagaccaagatgcaattatggaaacggtatcaaggagtggaatgcgtgctgctgtttcaagaactttatttagcttcggaacgaaagacgatgaaaagaaagcaattgaagaagctgagaaatatgtgaagcgttactataacgaaagtggtatgttaactacgatggttgcaccacatagtccatatacatgttccacagaactgttagaagagtgtgctcgtattgcagtagaaaatcaaacgatggttcatattcatctttctgaaacagagcgtgaagtacgtgatattgaagcacagtatgggaagcgtccagtagaatatgcagcaagttgtggattgtttaaacgcccaacagttattgcgcacggtgtagtattaaatgaaaatgagcgtgcatttttagcagaatatgatgttcgagtagctcataacccaaatagtaatttaaaactaggttctggtatagcgaatgtaaaagcgatgctagaagcagggattaaagtagggattgcaacagatagtgttgcgtctaataataatttagatatgtttgaagaaatgcgtatagcaacattattacaaaaaggtattcatcaagatgcaacagcgttaccagttgaaacagctcttacacttgcgactaaaggagctgctgaagtaatcgggatgaaacaaacgggctcacttgaggttggaaagtgtgctgattttattacgattgacccatctaataagccgcatttacaaccagcagatgaagtgttatcacatcttgtgtatgcagctagtggaaaagatataagcgatgtaattattaatggtaaacgtgtcgtttggaatggtgaatgtaaaacattagatgaagagcgtattatatttgaagcaagtcgttataaacgaggtttacaaagatag

SEQ ID NO: 100 - DNA, 1326 bp, Bacillus cereus
ttgaaaggggaaatacttttgaaaacaacttatgtaaacgctacaattgcaacgatgaatgaacaaaatgaagtgatagaaaatggatatatcattgtagaaaatgatcaaattatagatgtaaatagcggagaattcgctaacgattttgaagtagatgaagtaattgacatgaaaggaaagtgggttttaccagggcttgtcaatacacatacacatgttgttatgagccttttgagaggtatcggagatgatatgttattgcagccatggcttgagacgagaatttggccacttgaaagtcagtttacgccagagcttgcggtcgctagcacggaattaggattacttgaaatggtgaaaagtggtacaacatcattctctgatatgtttaatcctattggagtagaccaagatgcaattatggaaacggtatcaagaagtggaatgcgtgctgctgtttcaagaactttatttagcttcggaacgaaagacgatgaaaagaaagcaattgaagaagctgagaaatatgtgaagcgttactataacgaaagtggtatgttaactacgatggttgcaccgcatagtccatatacatgttccacagaactgttagaagagtgtgctcgtattgcagtagaaaatcaaacgatggttcatattcatctttctgaaacagagcgtgaagtacgtgatattgaagcacagtatgggaagcgtccagtagaatatgcagcaagttgcggattgtttaaacgcccaacagttattgcgcacggtgtagtattaaatgaaaatgagcgtgcatttttagcagaacatgatgttcgagtagctcataacccaaatagtaatttaaaactaggttctggtatagcgaatgtaaaagcgatgctagaagcaggaataaaagtaggaattgcaacagatagtgtggcgtctaacaacaatttagatatgtttgaagaaatgcgtatagcgactttattacaaaaaggtattcatcaagatgcaacagcattaccagttgaaacagctctttctcttgcgacaaaaggagctgcggaagtaattggtatgaaacaaacgggatcacttgaggttggtaagtgtgctgattttattacgattgatccatctaataagccacatttacaaccggcagatgaagtgttatcacattttgtgtatgcagctagtggaaaagatataagcgatgtaattattaatggtaaacgtgtcgtttggaatggtgaatgtaaaacgttagatgaagagcgtattatatttgaagcaagtcgttataaacgaggcttacaaagatag

SEQ ID NO: 101 - DNA, 1326 bp, Bacillus cereus
ttgaaaggggaaatacttttgaaaacaacttatgtaaacgctacaattgtaacgatgaatgaacaaaacgaagtgatagaaaatggatatatcattgtagaaaatgatcaaattatagatgtaaagagcggagaattcgttaatgattttgaagtagatgaagtaattgacatgaaaggaaagtgggttttaccagggcttgtaaatacacatacacacgttgtaatgagtctcttaagaggtattggagatgatatgttattacagccatggcttgagacgagaatttggccactggaaagtcaatttactccccaaattgcggtcgctagtacggaattaggattacttgagatggtgaaaagtggtacaacatcattctctgacatgtttaatccaattggagtagatcaagacgcaattatggaaacggtatcaaggagcgggatgcgagctgctgtttcaagaactttatttagcttcggaacgaaagacgatgaaaagaaagcaattgaagaagctgaaaaatatgtgaagcgttactataacgaaagtggtatgttaactacgatggttgcacctcatagtccatatacatgttccacagaactattagaagaatgcgcacgtattgcagtagaaaatcaaacgatggttcatattcatctttcagaaacagagcgtgaagtacgtgatattgaagcgcaatacggaaaacgtccagtagaatatgcagcaagttgtggattgtttaaacgcccaacagttattgcacacggtgtagtattaaatgaaaatgaacgtgcttttttagcagaacatgatgttcgagtagctcataacccgaatagtaatttaaaactaggttctggtatagcaaatgtaaaagcgatgctagaagcaggaatgaaagtaggaattgcaacagatagtgtggcatctaacaacaatttagatatgtttgaagaaatgcgtatagcaacattattacaaaaaggtattcatcaagatgcaacagcgttaccagttgaaacggctcttacacttgcgactaaaggagctgctgaagtaatcggcatgaaacaaacaggatcacttgaggttggaaagtgtgccgattttattacgattgacccatctaataagccgcatttacaaccagcagatgaagtgttatcgcatcttgtatatgctgccagtggaaaagatattagcgatgtcattattaatggaaaccgtgtcgtttggaatggcgaatgtaaaacgttagatgaagagcgtattatatttgaagcaagtcgttataaacgaggtttgcaaagatag

SEQ ID NO: 102 - DNA, 1308 bp, Bacillus cereus
ttgaaaacaacttatgtaaacgctacaatcgtaacgatgaatgaacaaaatgaagtgatagaaaatggatatatcattgtagaaaatgatcaaattatagatgtgaagagcggagaattcgctaatgattttgaagtagatgaagtaattgacatgaaaggaaaatgggttttaccagggcttgtcaatacacatacacacgttgtaatgagtctcttaagaggtattggtgatgatatgttattacagccgtggcttgagacaagaatttggccacttgaaagtcaatttactccagaacttgcggttgctagtacggaactaggattacttgaaatggtgaaaagtggtacaacatcattctctgatatgtttaatccaattggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataacgaaagtggtatgttaactacgatggttgcaccgcatagtccatatacatgcagtacagaactgttagaagagtgtgcacgtattgcagtagaaaatcaaacgatggttcatattcacctttcggaaacagagcgtgaagtacgtgatattgaagcaaagtacggaaaacgtccagtagaatatgcagcaagttgcggattgtttaaacgaccgacagttattgcacacggtgtagtattaaatgacaatgagcgtgcatttttagcggaacatgacgttcgagtagctcataatccgaatagtaatttaaaactagggtctggtatagcgaatgtaaaagcgatgctagaagcaggaataaaagtaggaattgcaacagatagtgtggcatctaacaataatttagatatgtttgaagaaatgcgcatagcgactttactacaaaaaggtattcaccaagatgcaacagcgttaccggttgaaacagctcttacacttgcgacaaaaggagctgcggaagtaatcggtatgaaacaaacaggatcacttgaggttggaaagtgtgcggattttattacgattgacccgtctaataagccgcatttacaaccagcggatgaagtgctatcacaccttgtatatgctgctagtggaaaagatataagtgatgtaatcattaacggaaaacgtgtcgtttggaatggcgaatgtaaaacgttagatgaagagcgtattatatttgaagcaagtcgatataaacgaggtttgcaaagataa

SEQ ID NO: 103 - DNA, 1308 bp, Bacillus cereus
ttgaaaacaacttatgtaaacgctacaatcgtaacgatgaatgaacaaaatgaagtgatagaaaatggatatatcattgtagaaaatgatcaaattatagatgtgaagagcggagaattcgctaatgattttgaagtagatgaagtaattgacatgaaaggaaagtgggttttaccagggcttgtaaatacacatacacacgttgtaatgagtctcttaagaggtattggtgatgatatgttattacaaccatggcttgagacgagaatttggccacttgaaagtcagtttactccagagcttgcggtcgctagtacggaattaggattacttgaaatggtgaaaagtggtacaacatcattctctgatatgtttaatccaattggagtagatcaagatgcaattatggaaacggtatcaaggagcgggatgcgagctgctgtttcaagaactttatttagcttcggaacgaaagatgatgaaaagaaagccgttgaagaagctgaaaaatatgtgaagcgttactataatgaaagtggtatgttaactacgatggttgcaccgcatagtccatatacatgttccacagaactattagaagaatgcgcacgtattgcagtagaaaatcaaacgatggttcatattcacctttcggaaacagagcgtgaagtacgtgatattgaagcacagtacggaaaacgtccagtagaatatgcagcaagttgtgggttatttaaacgcccaacagttattgcacacggtgtagtattaaatgaaaatgagcgtgcatttttagcagaacatgatgttcgagtagcacataacccgaatagtaatttaaaactaggttctggtatagcgaatgtaaaagcgatgctagaaacaggagtgaaagtaggtattgcaacagatagtgtggcatcaaacaacaatttagatatgtttgaagaaatgcgcatcgcaacattattacaaaaaggtattcatcaagatgcaacagcgttaccggttgaaacagctcttacacttgcaactaaaggagcggctgaagtaatcggcatgaaacaaacaggatcacttgaggttggaaagtgcgctgatttcattacaattgatccgtctaataagcctcatttacaaccagcggatgaagtgttatcacaccttgtatatgctgctagtggaaaagatataagcgatgtaattattaacggaaaacttgtcgtttggaatggcgaatgtaaaacgttagatgaagagcgtattatatttgaagcgagtcgatataaacgaggtttgcaaagatag

SEQ ID NO: 104 - DNA, 1326 bp, Bacillus cereus
ttgaaaggggaaatacttttgaaaacaacttatgtaaacgctacaattgtaacgatgaatgaacaaaacgaagtgatagaaaatggatatatcattgtagaaaatgatcaaattatagatgtaaagagcggagaattcgctaatgattttgaagtagatgaagtaattgacatgaaaggaaagtgggttttaccagggcttgtaaatacacatacacacgttgtaatgagccttttaagaggtattggcgatgatatgttattacagccgtggcttgagacgagaatttggccacttgaaagtcagtttactccagagcttgcggtcgctagtacggaattaggattacttgaaatggtgaaaagtggtacgacatcattctctgatatgtttaatccaattggagtagatcaagatgcaattatggagacggtatcaaggagtggaatgcgcgctgctgtttcaagaactttatttagctttggaacgaaagaagatgaaaagaaagcaattgaagaagctgagaaatatgtgaagcgttattataacgaaagtggaatgttaactacgatggttgcaccacatagtccatatacatgttccacagaactgttagaagagtgcgcacgtattgcagtagaaaatcaaactatggttcatattcacctttcggaaacagagcgtgaagtacgtgatattgaagcgcagtacggaaaacgtccggtagaatatgcagcaagttgcggattgtttaaacgcccaacagttattgcgcatggtgtagtattaaatgaaaatgagcgtgcatttttagcagaacatgatgttcgagtagctcataatccgaatagtaatttaaaactaggttctggtatagcgaatgtgaaagcgatgctagaagcaggaattaaagtagggattgcaacagatagtgttgcgtctaataataatttagatatgtttgaagaaatgcgcattgcaactttattacaaaaaggtattcatcaagacgcaacagcattgccagtagaaactgctctttctctagcgacaaaaggagctgcagaagtaattggtatgaaacaaactggatcacttgaggttggaaagtgtgctgattttattgcgattgatccgtctaataaaccgcatttacaaccagctgatgaagtgttatcacaccttgtatatgcagctagtggaaaagatataagtgatgtaattattaacggaaaacgtgtcgtttggaatggtgaatgtaaaacgttagatgaagagcgtattatatttgaagcaagtcgttataaacgaggtttacaaagatag

SEQ ID NO: 105 - DNA, 1326 bp, Bacillus cereus
ttgaaaggggaaatacttttgaaaacaacttatgtaaacgctacaatcgtaacgatgaatgaacaaaatgaagtgatagaaaatggatatatcattgtagaaaatgatcaaattatagatgtgaagagcggagaattcgctaatgattttgaagtagatcaagtaattgacatgaaaggaaagtgggttttaccagggcttgtaaatacacatacacacgttgtaatgagtctcttaagaggtattggcgatgatatgttattacaaccatggcttgagacgagaatttggccacttgaaagtcaatttactccagaacttgcggttgctagtacggagctaggattacttgaaatggtgaaaagtggtacaacatcattctctgatatgtttaatccaattggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataacgaaagtggtatgttaactacgatggttgcaccgcatagcccatatacatgcagtacagaactgttagaagagtgtgcacgtattgcagtagaaaatcaaacgatggttcatattcacctttcggaaacagagcgtgaagtacgtgatattgaagcacagtatggaaaacgtccagtagaatatgcagcaagttgcggattgtttaaacgaccgacggttattgcacacggtgtagtattaaatgacaatgagcgtgcatttttagcagaacatgacgttcgagtagctcataatccgaatagtaatttaaaactaggttctggtatagcgaatgtaaaagcgatgctagaagcgggaatgaaagtaggaattgcaacagatagtgttgcatctaacaacaatttagatatgtttgaggaaatgcgcattgcaactttattacaaaaaggtattcaccaagacgcaacagcgttaccggttgaaacagctcttacacttgcaactaagggagctgctgaagtaattgggatgaaacaaacaggctcacttgagattggaaagtgtgctgattttattacaattgacccgtctaataaaccgcatttacaaccagcagatgaagtgttatcacaccttgtatatgctgctagtggaaaagatataagcgatgtaattattaacggaaaacgtgttgtttggaatagcgaatgtaaaacgttagatgaagagcgtattatatttgaagcaagtcgttataaacgaggtttgcaaagatag

SEQ ID NO: 106 - DNA, 1308 bp, Bacillus sp.
ttgaaaacaacttatgtaaacgctacaattgtaacgatgaatgaacaaaacgaagtgatagaaaatggatatatcattgtagaaaatgatcaaattatagatgtaaagagcggagaattcgctaatgattttgcagtagatgaagtaattgacatgaaaggaaagtgggttttaccagggcttgtaaatacacatacacacgttgtaatgagtctcttaagaggtattggcgatgatatgttattacaaccatggctggagacgagaatttggccacttgaaagtcagtttactccagagcttgcggttgctagtacggaattaggattacttgaaatggtgaaaagtggtacaacatcattctctgacatgtttaatccaattggagtagatcaagatgcaattatggaaacggtatcaaagagtgggatgcgagctgctgtttcaagaactttatttagcttcggaacgaaagacgatgaaaagaaagcaatcgaagaagctgagaaatatgtgaagcgttactataacgaaagtggcatgttaactacgatggttgcaccgcatagtccatatacatgtagtgcagaactgttagaagagtgcgctcgtattgcagtagaaaatcaaacgatggttcatattcatctttcggaaacagagcgtgaagtacgtgatattgaagcgcagtacgggaaacgtccagtagaatatgcagcaagttgcgggttgtttaaacgcccaacagttattgcacacggtgtagtattaaatgaaaatgagcgtgcatttttaggagaacatgatgttcgagtagcacataacccaaatagtaatttaaaactaggttctggtatagcaaatgtaaaagcgatgctagaggcaggaatgaaagtaggaattgcaacagatagtgtggcatctaacaacaatttagatatgtttgaagaaatgcgcatagcgactttactacaaaaaggtattcaccaagatgcaacagcgttaccagttgaaacagctcttacacttgcgactaaaggagctgctgaagtaatcgggatgaaacaaacaggatcacttgaggttggaaagtgtgctgattttattacgattgacccatctaataagccgcatttacaaccagcagatgaagtgttatcgcacctggtatatgcagctagtggaaaagatataagcgatgtaattattaacggaaagcgtgtcgtttggaatggcgaatgtaaaacgttagatgaagagcgtattatatttgaagcgagtcgttataaacgaggtttacaaagatag

SEQ ID NO: 107 - DNA, 1326 bp, Bacillus thuringiensis
ttgaaaggggaaatacttttgaaaacaacttatgtaaacgctacaattgtaacgatgaatgaacaaaacgaagtgatagaaaatggatatatcattgtagaaaatgatcaaattatagatgtaaagagcggagaattcgctaatgattttgcagtagatgaagtaattgacatgaaaggaaagtgggttttaccagggcttgtaaatacacatacacacgttgtaatgagtctcttaagaggtattggcgatgatatgttattacaaccatggctggagacgagaatttggccacttgaaagtcagtttactccagagcttgcggttgctagtacggaattaggattacttgaaatggtgaaaagtggtacaacatcattctctgacatgtttaatccaattggagtagatcaagatgcaattatggaaacggtatcaaagagtgggatgcgagctgctgtttcaagaactttatttagcttcggaacgaaagacgatgaaaagaaagcaatcgaagaagctgagaaatatgtgaagcgttactataacgaaagtggcatgttaactacgatggttgcaccgcatagtccatatacatgtagtgcagaactgttagaagagtgcgctcgtattgcagtagaaaatcaaacgatggttcatattcatctttcggaaacagagcgtgaagtacgtgatattgaagcgcagtacgggaaacgtccagtagaatatgcagcaagttgcgggttgtttaaacgcccaacagttattgcacacggtgtagtattaaatgaaaatgagcgtgcatttttaggagaacatgatgttcgagtagcacataacccaaatagtaatttaaaactaggttctggtatagcaaatgtaaaagcgatgctagaggcaggaatgaaagtaggaattgcaacagatagtgtggcatctaacaacaatttagatatgtttgaagaaatgcgcatagcgactttactacaaaaaggtattcaccaagatgcaacagcgttaccagttgaaacagctcttacacttgcgactaaaggagctgctgaagtaatcgggatgaaacaaacaggatcacttgaggttggaaagtgtgctgattttattacgattgacccatctaataagccgcatttacaaccagcagatgaagtgttatcgcacctggtatatgcagctagtggaaaagatataagcgatgtaattattaacggaaagcgtgtcgtttggaatggcgaatgtaaaacgttagatgaagagcgtattatatttgaagcgagtcgttataaacgaggtttacaaagatag

SEQ ID NO: 108 - DNA, 1326 bp, Bacillus cereus
ttgaaaggggaaatacttttgaaaacaacttatgtaaacgctacaatcgtaacgatgaatgaacaaaatgaagtgatagaaaatggatatatcattgtagaaaatgatcaaattatagatgtgaagagcggagaattcgctaatgattttgaagtagatgaagtaattgacatgaaaggaaaatgggttttaccagggcttgtcaatacacatacacacgttgtaatgagtctcttaagaggtattggtgatgatatgttattacagccgtggcttgagacaagaatttggccacttgaaagtcaatttactccagagcttgcggtcgctagtacggaactaggattacttgaaatggtgaaaagtggtacaacatcattctctgatatgtttaatccaattggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataacgaaagtggtatgttaactacgatggttgcaccgcatagtccatatacatgcagtacagaactgttagaagagtgtgcacgtattgcagtagaaaatcaaacgatggttcatattcacctttcggaaacagagcgtgaagtacgtgatattgaagcaaagtacggaaaacgtccagtagaatatgcagcaagttgcggattgtttaaacgaccgacagttattgcacacggtgtagtattaaatgacaatgagcgtgcatttttagcggaacatgacgttcgagtagctcataatccgaatagtaatttaaaactagggtctggtatagcgaatgtaaaagcgatgctagaagcaggaataaaagtaggaattgcaacagatagtgttgcatctaacaacaatttagatatgtttgaggaaatgcgcattgcaactttattacaaaaaggtattcaccaagacgcaacagcgttaccggttgaaacagctcttacacttgcaactaagggagctgctgaagtaattgggatgaaacaaacaggctcacttgagattggaaagtgtgctgatttcattacaattgacccgtctaataaaccgcatttacaaccagcagatgaagtgttatcacaccttgtgtatgctgctagtggaaaagatataagtgatgtaatcattaacggaaaacgtgtcgtttggaatggcgaatgtaaaacgttagatgaagagcgtattatatttgaagcaagtcgatataaacgaggtttgcaaagataa

SEQ ID NO: 109 - DNA, 1308 bp, Bacillus cereus
ttgaaaacaacttatgtaaacgctacaattgtaacgatgaatgaacaaaacgaagtgatagaaaatggatatatcattgtagaaaatgatcaaattatagatgtaaagagcggagaattcgctaatgattttgaagtagatgaagtaattgacatgaaaggaaagtgggttttaccagggcttgtaaatacacatacacatgttgtaatgagtcttttaagaggtattggagatgatatgttattacagccatggcttgagacgagaatttggccactggaaagtcaatttactccccaaattgcggtcgctagtacggaattaggattacttgagatggtgaaaagtggtacaacatcattctctgacatgtttaatccaattggagtagatcaagacgcaattatggaaacggtatcaaggagcgggatgcgagctgctgtttcaaggactttatttagcttcggaacgaaagacgatgaaaagaaagcgattgaagaagctgagaaatatgtgaagcgttactataacgaaagtggcatgttaactacgatggttgcaccacatagtccatatacatgtagtacagaattgttagaagagtgcgcacggattgcagtagagaatcaaacgatggttcatatccacctttctgaaacagagcgtgaagtacgtgatattgaagcacaatatggaaaacgtccagtagaatatgcagcgagctgcggattgtttaaacgcccaacagttattgcacacggtgtagtattaaatgacgatgagcgtgcatttttagcagagcatgatgttcgagtagctcataatccaaatagtaatttaaaactaggttctggtatagcgaatgtaaaagcgatgctagaagcaggaataaaagtaggaattgcaacagatagtgttgcatctaacaataatttagacatgtttgaagaaatgcgcatagcgactttactacaaaaaggtattcaccaagatgcaacagctttaccagttgaaacagctcttacacttgcgactaaaggggctgctgaagtaatcgggatgaaacaaacaggatcacttgaggttggaaaatgtgctgattttattacgattgatccatctaataagccgcatttacaaccagcagatgaagtgttatcacatcttgtgtatgctgctagtggaaaagatataagcgatgtaattattaacggaaaacgtgtcgtttggaatggcgaatgtaaaacgttagatgaagagcgtattatatttgaagcaagtcgttataaacgaggtttgcaaagatag

SEQ ID NO: 110 - DNA, 1308 bp, Bacillus cereus
ttgaaaacaacttatgtaaacgctacaatcgtaacgatgaatgaacaaaatgaagtgatagaaaatggatatatcattgtagaaaatgatcaaattatagatgtgaagagcggagaattcgctaatgattttgaagtagatgaagtaattgacatgaaaggaaaatgggttttaccagggcttgtcaatacacatacacacgttgtaatgagtctcttaagaggtattggtgatgatatgttattacagccgtggcttgagacaagaatttggccacttgaaagtcaatttactccagagcttgcggtcgctagtacggaactaggattacttgaaatggtgaaaagtggtacaacatcattctctgatatgtttaatccaattggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataacgaaagtggtatgttaactacgatggttgcaccgcatagtccatatacatgcagtacagaactgttagaagagtgtgcacgtattgcagtagaaaatcaaacgatggttcatattcacctttcggaaacagagcgtgaagtacgtgatattgaagcaaagtacggaaaacgtccagtagaatatgcagcaagttgcggattgtttaaacgaccgacagttattgcacacggtgtagtattaaatgacaatgagcgtgcatttttagcggaacatgacgttcgagtagctcataatccgaatagtaatttaaaactagggtctggtatagcgaatgtaaaagcgatgctagaagcaggaataaaagtaggaattgcaacagatagtgttgcatctaacaacaatttagatatgtttgaggaaatgcgcattgcaactttattacaaaaaggtattcaccaagacgcaacagcgttaccggttgaaacagctcttacacttgcaactaagggagctgctgaagtaattgggatgaaacaaacaggctcacttgagattggaaagtgtgctgatttcattacaattgacccgtctaataaaccgcatttacaaccagcagatgaagtgttatcacaccttgtgtatgctgctagtggaaaagatataagtgatgtaatcattaacggaaaacgtgtcgtttggaatggcgaatgtaaaacgttagatgaagagcgtattatatttgaagcaagtcgatataaacgaggtttgcaaagataa

SEQ ID NO: 111 - DNA, 1326 bp, Bacillus cereus
ttgaaaggggaaatacttttgaaaacaacttatgtaaacgctacaatcgtaacgatgaatgaacaaaatgaagtgatagaaaatggatatatcattgtagaaaatgatcaaattatagatgtaaagagcggagaattcgctaatgattttgaagtagatgaagtaattgacatgaaaggaaagtgggttttaccagggcttgtcaatacacatacacacgttgtaatgagtctcttaagaggtattggtgatgatatgttattacaaccatggcttgaaacgagaatttggccacttgaaagtcaatttactccagagcttgcggttgctagtacggaattaggattacttgaaatggtgaaaagtggtacaacatctttctctgatatgtttaatccaattggagtagatcaagatgcaattatggaaacggtatcaaggagcgggatgcgagctgctgtttcaagaactttatttagcttcggaacgaaagaggatgaaaagaaagcaatcgaagaagctgagaaatatgtgaagcgttactataacgaaagtggtatgttaactacgatggttgcaccgcatagcccatatacatgcagtacagaactgttagaagagtgtgcacgtattgcagtagaaaatcaaacgatggttcatattcacctttcggaaacagagcgtgaagtacgtgatattgaagcacagtacggaaaacgtccagtagaatatgcagcaagttgcggattgtttaaacgaccgacggttattgcacacggtgtagtattaaatgacaatgagcgtgcatttttagcagaacatgacgttcgagtagctcataatccgaatagtaatttaaaactaggttctggtatagcgaatgtaaaagcgatgctagaagcgggaatgaaagtaggaattgcaacagatagtgtggcatctaacaacaatttagatatgtttgaggaaatgcgcattgcaactttattacaaaaaggtattcaccaagacgcaacagcgttaccggttgaaacagctcttacacttgcaactaagggagctgctgaagtaattgggatgaaacaaacaggctcacttgaagctggaaagtgtgccgattttattacgattgatccttctaataagccgcatttacaaccagcggatgaagtgttatcacaccttgtatatgctgctagtggaaaagatataagcgatgtaattattaacggaaaacatgtcgtttggaatggtgaatgtaaaacgttagatgaagagcgtattatatttgaagcaagtcgttataaacgaggtttgcaaagatag

SEQ ID NO: 112 - DNA, 1326 bp, Bacillus sp.
ttgaaaggggaaatacttttgaaaacaacttatgtaaacgctacaatcgtaacgatgaatgaacaaaatgaagtgatagaaaatggatatatcattgtagaaaatgatcaaattatagatgtgaagagcggagaattcgctaatgattttgaagtagatgaagtaattgacatgaaaggaaaatgggttttaccagggcttgtcaatacacatacacacgttgtaatgagtctcttaagaggtattggtgatgatatgttattacagccgtggcttgagacaagaatttggccacttgaaagtcaatttactccagaacttgcggttgctagtacggaattaggattacttgaaatggtgaaaagtggtacaacatctttctctgatatgtttaatccaattggagtagatcaagatgcaattatggaaacggtatcaaggagcgggatgcgagctgctgtttcaagaactttatttagcttcggaacgaaagaggatgaaaagaaagcaattgaagaagctgagaaatatgtgaagcgttactataacgaaagtggtatgttaactacgatggttgcaccgcatagtccatatacatgcagtacagaactgttagaagagtgtgcacgtattgcagtagaaaatcaaacgatggttcatattcacctttccgaaacagagcgtgaagtacgtgatattgaagcgcagtacggaaaacgtccagtagaatatgcggcaagttgcggattgtttaaacgaccaacagtgattgcacacggtgtagtattagatgacaatgagcgtgcatttttagcggaacatgacgttcgagtagctcataatccgaatagtaatttaaaactagggtctggtatagcgaatgtaaaagcgatgttagaagcaggaatgaaagtaggaattgcaacagatagtgttgcatctaacaataatttagatatgtttgaagaaatgcgcatagcgactttactacaaaaaggtattcaccaagatgcaacagcgttaccggttgaaacagctcttacacttgcaactaaaggagcggctgaagtaatcggcatgaaacaaacaggatcacttgaggttggaaagtgcgctgatttcattacaattgatccgtctaataagccccatttacaaccagcagatgaagtattatcgcatcttgtatatgctgctagtggaaaagatataagcgatgtaattattaacggaaaacatgtcgtttggaatggcgaatgtaaaacgttagatgaagagcgtattatatttgaagcaagtcgatataaacgaggtttgcaaagatag

SEQ ID NO: 113 - DNA, 1326 bp, Bacillus cereus
ttgaaaggggaaatacttttgaaaacaacttatgtaaacgctacaatcgtaacgatgaatgaacaaaatgaagtgatagaaaatggatatatcattgtagaaaatgatcaaattatagatgtgaagagcggagaattcgctaatgattttgaagtagatgaagtaattgacatgaaaggaaaatgggttttaccagggcttgtcaatacacatacacacgttgtaatgagtctcttaagaggtattggtgatgatatgttattacagccgtggcttgagacaagaatttggccacttgaaagtcaatttactccagaacttgcggttgctagtacggaactaggattacttgaaatggtgaaaagtggtacaacatcattctctgatatgtttaatccaattggagtagatcaagatgcaattatggaaacggtatcaaggagcgggatgcgagctgctgtttcaagaactttatttagctttggaacgaaagaggatgaaaagaaagcaattgaagaagctgagaaatatgtgaagcgttactataacgaaagtggtatgttaactacgatggttgcaccgcatagtccatatacatgcagtacagaactgttagaagagtgtgcacgtattgcagtagaaaatcaaacgatggttcatattcacctttcggaaacagagcgtgaagtacgtgatattgaagcaaagtacggaaaacgtccagtagaatatgcagcaagttgcggattgtttaaacgaccgacagttattgcacacggtgtagtattaaatgacaatgagcgtgcatttttagcggaacatgacgttcgagtagctcataatccgaatagtaatttaaaactagggtctggtatagcgaatgtaaaagcgatgctagaagcaggaataaaagtaggaattgcaacagatagtgtggcatctaacaataatttagatatgtttgaagaaatgcgcatagcgactttactacaaaaaggtattcaccaagatgcaacagcgttaccggttgaaacagctcttacacttgcgacaaaaggagctgtggaagtaatcggtatgaaacaaacaggatcacttgaggttggaaagtgtgcggattttattacgattgacccgtctaataagccgcatttacaaccagcggatgaagtgctatcacaccttgtatatgctgctagtggaaaagatataagtgatgtaatcattaacggaaaacgtgtcgtttggaatggcgaatgtaaaacgttagatgaagagcgtattatatttgaagcaagtcgatataaacgaggtttgcaaagataa

SEQ ID NO: 114 - DNA, 1326 bp, Streptococcus pneumoniae
ttgaaaggggaaatacttttgaaaacaacttatgtaaacgctacaattgtaacgatgaatgaacaaaatgaagtgatagaaaatggatatatcattgtagaaaatgatcaaattatagatgtaaagagtggagaattcgctagtgattttgaagtagatgaagtaattgacatgaaaggaaagtgggttttaccaggtcttgtcaatacacatacacacgttgtaatgagtctcttaagaggtattggtgatgatatgttattacagccgtggcttgagacgagaatttggccacttgaaagtcaatttactccccaaattgcggtcgctagtacggaattaggattacttgaaatggtgaaaagcggtacaacatcattctcggatatgtttaatccaattggagtagatcaagatgcaattatggaaacggtatcaagaagcggaatgcgagctgctgtttcaagaactttatttagctttggaacgaaagaagatgaaaagaaagcaattgaagaagctgagaaatatgtgaagcgttattataacgaaagtggtatgttaactacgatggttgcaccgcatagtccatatacatgtagtacagaactgttagaagagtgtgcacgtattgcagtagaaaatcaaacgatggttcatattcacctttccgaaacagagcgtgaagtacgtgatattgaagcgcagtacggaaaacgtccagtagaatatgcggcaagttgcggattgtttaaacgaccgacagtgattgcacacggtgtagtattaaatgacaatgagcgtgcatttttagcggaacatgacgttcgagtagctcataatccgaatagtaatttaaaactagggtctggtatagcgaatgtaaaagcgatgttagaagcaggaataaaagtaggaattgcaacagatagtgttgcatctaacaataatttagatatgtttgaagaaatgcgcatagccactttactacaaaaaggtattcaccaagatgcaacagctttaccagttgaaacagctcttacacttgcgacaaaaggagctgctgaagtaatcggcatgaaacaaacgggatcacttgaggttggaaagtgtgcggattttattacgattgacccgtctaataagccgcatttacaaccagcggatgaagtgctatcacaccttgtatatgctgctagtggaaaagatataagtgatgtaatcattaacggaaaacgtgtcgtttggaatggcgaatgtaaaacgttagatgaagagcgtattatatttgaagcaagtcgttataaacgaggtttacaaagatag

SEQ ID NO: 115 - DNA, 1395 bp, Unknown
  Bradyrhizobiaceae family
atgagcctgatcgcaattaagaatgccgattggattcttacgatggacggcgcccgccgagtgatagccgacgggtccatattgatagacaaggatcgtattagggcgatcggtaaatcggctgtgatagaaataccgccagaaacaacaaaggtgatcgatggtcgcggcaaagttgtattacccggcttgatcgattcccatacacatcattcactacatcttggtcgcggcctggcagatgaatgcgatattcaaacctttctatatcgacgtctgtatcccatagaggcctcacttaacgacgaagatgcgtatataagtgcgttattgtgtcagcttgaaatgattaagtctggcacgacgtcgattatcgatgccggaaactactttcctgaggctacgcttcgtgcattcggcactactggaatgcggggtgttgtagcaagaagtacgttcgatatacccacatcttcactaggctcattgccagcacaggtgttcgctgaagagaccaacgtggcacttaaacgcgcggaagagttcgtcgaaaggaacagtggtgcatgtgacggtcgtgtgcaagcttggctccaacttcgagttcttccgaattgttccgatgagctttgccgcggcttaaaaagtatcgctgatcgacttggcgttcgctatgaagcacatgccgccttcactaaagaggtctatgaagcctctaaactgcagtttggtaaatcggaggttcgccgcttggatgatctcgggatcctaggcgaaggattattgctggcgcatatgggctggttaacgccacgtgatatattgctgctcattagtagcaaaactaacgttgttctttgtccaacgtcgagtgtccatcaggcgatgggtagcattgcgttcggccacgtcccggaactgctggaaatgggggttaacgttgctcttggaacggacggcggtcctcacgggacgaacgatctcgttaggcaaatatttgtagcggcgggaggctataaggaggttcggctggacgcgacaataatgccacccgaaacagtgctagagatggcaaccgttaacggggcgcgcgcaatgggaatgtcagatcaggtcggatcgattgaaccgggcaagaaggcagacatcacaatttttgattcgcgacgaccggagtggaggcccttgcacaatcccgtcgcgaatctcgtttattgcgcaaacggaaattctgctgataccgttattgttgatgggcgtattttgatggagaatcgaaaaatcctcaccttcaacgaggatgatgtaataaccgaagctcagcgacgttcggttgagattggtgctcgcgccggattacttgagtacggaaggccgcggtggcccgtccattga

SEQ ID NO: 116 - DNA, 1029 bp, Pseudomonas sp.
atgccgcctggatgttccgggctttgtagctttgtaggattgacgatgccactcaagttttcgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcgccaaaaaggaggcattggggctgccgctgctgtacgcagtcaacaccagttatcatggcgatcactcgtatgggaacatgtacctgaaggcgccgacgcgtgtcatccaaagcaccaaaacgcgtgattatgtcgatggtcacctcgccgacgacaaggcattcatggtgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaacgcagtggtcgccagcaagccagctctaccttggctgctcgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggttcatccagatctcaacgtccccgctgcttacaaggatctcgcagccaggccttga

SEQ ID NO: 117 - DNA, 1026 bp, Paracoccus sp.
atgccgcctggatgttccgggctttgtagctttgtaggattgacgatgccactcaagttttcgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcgccaaaaaggaggcattggggctgccgctgctgtacgcagtcaacaccagttatcatggcgatcactcgtatgggaacatgtacctgaaggcgccgacgcgtgtcatccaaagcaccaaaacgcgtgattatgtcgatggtcacctcgccgacgacaaggcattcatggtgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaacgcagtggtcgccagcaagccagctctaccttggctgctcgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggttcatccagatctcaacgtccccgctgcttacaaggatctcgcagccagaatc

SEQ ID NO: 118 - DNA, 1026 bp, Rhodococcus sp.
atgccgcctggatgttccgggctttgtagctttgtaggattgacgatgccactcaagttttcgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcgccaaaaaggaggcattggggctgccgctgctgtacgcagtcaacaccagttatcatggcgatcactcgtatgggaacatgtacctgaaggcgccgacgcgtgtcatccaaagcaccaaaacgcgtgattatgtcgatggtcacctcgccgacgacaaggcattcatgatgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaacccagtggtcgccagcaagccagctctaccttggctgctcgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggttcatccagatctcaacgtccccgctgcttacaaggatctcgcagccaggcct

SEQ ID NO: 119 - DNA, 984 bp, Rhizobium sp.
atgccactcaagttttcgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcgccaaaaaggaggcattggggctgccgctgctgtacgcagtcaacaccagttatcatggcgatcactcgtatgggaacatgtacctgaaggcgccgacgcgtgtcatccaaagcaccaaaacgcgtgattatgtcgatggtcacctcgccgacgacaaggcattcatggtgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaacgcagtggtcgccagcaagccagctctaccttggctgctcgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggttcatccagatctcaacgtccccgctgcttacaaggatctcgcagccaggccttga

SEQ ID NO: 120 - DNA, 984 bp, Ochrobactrum lupine
atgccactcaagttttcgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcgccaaaaaggaggcattggggctgccgctgctgtacgcagtcaacaccagttatcatggcgatcactcgtatgggaacatgtacctgaaggcgccgacgcgtgtcatccaaagcaccaaaacgcgtgattatgtcgatggtcacctcgccgacgacaaggcattcatggtgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaactcagtggtcgccagcaagccagctctaccttggctgctcgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggttcatccagatctcaacgtccccgctgcttacaaggatctcgcagccaggccttga

SEQ ID NO: 121 - DNA, 984 bp, Bordetella sp.
atgccactcaagttttcgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcaccaaaaaggaggcattggggctgccgctgctgtacgcagtcaacaccagttatcatggcgatcactcgtatgggaacatgtacctgaaggcgccgacgcgtgtcatccaaagcaccaaaacgcgtgattatgtcgatggtcacctcgccgacgacaaggcattcatggtgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaacgcagtggtcgccagcaagccagctctaccttggctgctcgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggttcatccagatctcaacgtccccgctgcttacaaggatctcgcagccaggccttga

SEQ ID NO: 122 - DNA, 984 bp, Shinella sp.
atgccactcaagttttcgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcgccaaaaaggaggcattggggctgccgctgctgtacgcagtcaacaccagttatcatggcgatcactcgtatgggaacatgtacctgaaggcgccgacgcgtgtcatccaaagcaccaaaacgcgtgattatgtcgatggtcacctcgccgacgacaaggcattcatggtgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaacccagtggtcgccagcaagccagctctaccttggctgctcgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggttcatccagatctcaacgtccccgctgcttacaaggatctcgcagccaggccttga

SEQ ID NO: 123 - DNA, 984 bp, Ochrobactrum sp.
atgccactcaagtttttgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcgccaaaaaggaggcattggggctgccgctgctgtacgcagtcaacaccagttatcatggcgatcactcgtatgggaacatgtacctgaaggcgccgacgcgtgtcatccaaagcaccaaaacgcgtgattatgtcgatggtcacctcgccgacgacaaggcattcatggtgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaacgcagtggtcgccagcaagccagctctaccttggctgctcgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggttcatccagatctcaacgtccccgctgcttacaaggatctcgcagccaggccttga

SEQ ID NO: 124 - DNA, 984 bp, Lysobacter ruishenii
atgccactcaagttttcgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcgccaaaaaggaggcattggggctgccgctgctgtacgcagtcaacaccagttatcatggcgatcactcgtatgggaacatgtacctgaaggcgccgacgcgtgttatccaaagcaccaaaacgcgtgattatgtcgatggtcacctcgccgacgacaaggcattcatggtgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaacgcagtggtcgccagcaagccagctctaccttggctgcccgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggtccatccagatctcaacgtccccgctgcttacaaggatctcgcagccaggccttga

SEQ ID NO: 125 - DNA, 984 bp, Caulobacter sp.
atgccactcaagtttttgggcgtgctctgcgccagcctcctgaccatcaccctttcggtagccgcgcatgcaaccgaactcatcttggacttcaacaaggtgcagatgcgcagccaacaactcgcacctggggtgtacgcgcatctaccggcagactccgccgagctgaatgcaaaaggcggtgtagcaggcaccagcggtggcttgatcgtcgggacacgtggcgcgatgctgatcgagaccatgctcaaccgtcgccttttcgatcaggtccaagcactcgccaaaaaggaggcattggggctgccgctgctgtacgcagtcaacaccagttatcatggcgatcactcgtatgggaacatgtacctgaaggcgccgacgcgtgtcatccaaagcaccaaaacgcgtgattatgtcgatggtcacctcgccgacgacaaggcattcatggtgaagaatttcggtgccgggcgcggtgttgagcagatcacggcaaggacgggcgacatcctcgtgcctccgggaggtcgcgtgagcgtcgaccttggcggcaagactgttgagatcatcgacttcgggttcgcacagaccggcggggacctgttcgtctgggagccgcaatccaaagttatgtggacaggcaactcagtggtcgccagcaagccagctctaccttggctgctcgatggcaagctggtagagacgttggcgacgctacagaaagtctacgattttctaccgcctgatgccaccatcgtccctggacatggtgtacccatggcccgcgaaggcctgcgctggcatctggactacctcgcagccgtgcaagcaggcgtcaaggatgctttggctcgcaaactgagcctcgaacagacagtgaccgaactcaagatgccggagttccgcggctacgtactgttcgactgggttcatccagatctcaacgtccccgctgcttacaaggatctcgcagccaggccttga

SEQ ID NO: 126 - protein, 282 aa, Bacillus cereus
MNKKKKIQKSVLSFTLLFSLGISSFSLTTAIHADTREEPSVEKKRVSLTERTSLFFEYLQQGNYVEALQLTSAAFQSKFTANTLQNWWTQSGWSVIKIIGTPVIKERNLVHQTVEISGTTQGTTIPLLLKFTPGGKVDEVGVRTPPESYIIPHPSYDQPAFYQEREIVIGNSTYPLPATLTVPKHKAGEKVPVVVLVHGAGIHDRDSTYMGTKILRDLAVGLSSNGIAVLRYEKRTLEHALKMSAEPVTLDRDTTDDAIYAAKSAAHRKALIQTIFSFLDIV

SEQ ID NO: 127 - protein, 311 aa, Bacillus cereus
MNKKKKIQKSVLSFTLLFSLGISSFSLTTAIHADTREEPSVEKKRVSLTERTSLFFEYLQQGNYVEALQLTSAAFQSKFTANTLQNWWTQSGWSVIKIIGTPVIKERNLVHQTVEISGTTQGTTIPLLLKFTPGGKVDEVGVRTPPESYIIPHPSYDQPAFYQEREIVIGNSTYPLPATLTVPKHKAGEKVPVVVLVHGAGIHDRDSTYMGTKILRDLAVGLSSNGIAVLRYEKRTLEHALKMSAEPVTLDRDTTDDAIYAAKSAAQQEGIDPNNIFILGHSLGAGTMPRILSKAPSLLVRGSILLAPPAR

SEQ ID NO: 128 - protein, 423 aa, Bacillus cereus
MNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 129 - protein, 490 aa, Bacillus cereus; identical to SEQ ID NO: 67

SEQ ID NO: 130 - protein, 441 aa, Bacillus cereus
MKGEILLKTTYVNATIVTMNEQNEVIENGYIIVENDQIIDVKSGEFANDFAVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 131 - protein, 435 aa, Bacillus cereus
MKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYKESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 132 - protein, 441 aa, Bacillus cereus
MKGEILLKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSKSGMRAAVSRTLFSFGTKDDEKKAIEEAEKYVKRYYNESGMLTTMVAPHSPYTCSTELLEECARIAVENQTMVHIHLSETEREVRDIETQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 133 - protein, 435 aa, Bacillus cereus
MKTTYVNATIVTMNEQNEVIENGYIIVENDQIIDVKSGEFANNFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSKSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 134 - protein, 441 aa, Bacillus cereus
MKGEILLKTTYVNATIVTMNEQNEVIENGYIIVENDQIIDVKSGEFANNFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSKSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 135 - protein, 435 aa, Bacillus cereus
MKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNDNERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEIGKCADFITIDPSNKPHLQPADEVLSHLVYAASGKDISDVIINGKRVVWNGECKTLDEERIIFEASRYKRGLQR

SEQ ID NO: 136 - protein, 441 aa, Bacillus cereus
MKGEILLKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNDNERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEIGKCADFITIDPSNKPHLQPADEVLSHLVYAASGKDISDVIINGKRVVWNGECKTLDEERIIFEASRYKRGLQR

SEQ ID NO: 137 - protein, 435 aa, Bacillus cereus
MKTTYVNATIVTMNEQNEVIENGYIIVENDQIIDVKSGEFANDFAVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSAELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 138 - protein, 435 aa, Bacillus mycoides
MKTTYVNATIATMNEQNEVIENGYIIVENDQIIDVNSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 139 - protein, 435 aa, Bacillus weihenstephanensis
LKTTYVNATIATMNEQNEVIENGYIIVENDQIIDINSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 140 - protein, 435 aa, Bacillus cereus
MKTTYVNATIVTMNEQNEVIENGYIIVENDQIIDVKSGEFANDFAVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEAGRYKRGLQR

SEQ ID NO: 141 - protein, 441 aa, Bacillus thuringiensis
MKGEILLKTTYVNATIVTMNEQNEVIENGYIIVENDQIIDVKSGEFTNDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEIGKCADFITIDPSNKPHLQPADEVLSHLVYAASGKDISDVIINGKRVVWNGECKTLDEERIIFEASRYKRGLQR

SEQ ID NO: 142 - protein, 437 aa, Bacillus mycoides
MKGEILLKTTYVNATIATMNEQNEVIENGYIIVENDQIIDINSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKR

SEQ ID NO: 143 - protein, 435 aa, Bacillus cereus
MKTTYVNATIVTMNEQNEVIENGYIIVENDQIIDVKSGELANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSKSGIRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 144 - protein, 435 aa, Bacillus mycoides
MKTTYVNATIATMNEQNEVIENGYIIVENDQIIDVNSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGIKVGIATDSVASNNNLDMFEEMRIATLLQKGIHQDATALPVETALSLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 145 - protein, 435 aa, Bacillus thuringiensis
MKTTYVNATIVTMNEQNEVIENGYIIVENDQIIDVKSGEFANDFAVDEVIDMKGKWVLPGLVNTHTHVVMSLLRGIGDDMLLQPWLETRIWPLESQFTPELAVASTELGLLEMVKSGTTSFSDMFNPIGVDQDAIMETVSKSGMRAAVSRTLFSFGTKDDEKKAIEEAEKYVKRYYNESGMLTTMVAPHSPYTCSAELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 146 - protein, 435 aa, Bacillus cereus
MKTTYVNATIVTMNEQNEVIENGYIIVENDQIIDVKSGEFANNFEVDEVIDMKGKWVLPGLVNTHTHVVMSLLRGIGDDMLLQPWLETRIWPLESQFTPELAVASTELGLLEMVKSGTTSFSDMFNPIGVDQDVIMETVSKSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 147 - protein, 435 aa, Bacillus cereus
MKTTYVNATIVTMNEQNEVIENGYIIVENDQIIDVKSGEFATDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNDNERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEIGKCADFITIDPSNKPHLQPADEVLSHLVYAASGKDISDVIINGKRVVWNGECKTLDEERIIFEASRYKRGLQR

SEQ ID NO: 148 - protein, 441 aa, Bacillus cereus
MKGEILLKTTYVNATIATMNEQNEVIENGYIIVENDQIIDINSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNKNERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 149 - protein, 441 aa, Bacillus thuringiensis
MKGEILLKTTYVNATIVTMNEQNEVIENGYIIVENDQIIDVKSGEFANDFAVDEVIDMKGKWVLPGLVNTHTHVVMSLLRGIGDDMLLQPWLETRIWPLESQFTPELAVASTELGLLEMVKSGTTSFSDMFNPIGVDQDAIMETVSKSGMRAAVSRTLFSFGTKDDEKKAIEEAEKYVKRYYNESGMLTTMVAPHSPYTCSAELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 150 - protein, 441 aa, Streptococcus pneumoniae
MKGEILLKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAKYGKRPVEYAASCGLFKRPTVIAHGVVLNDNERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 151 - protein, 441 aa, Bacillus cereus
MKGEILLKTTYVNATIATMNEQNEVIENGYIIVENDQIIDINSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEYDVRVAHNPNSNLKLGSGIANVKAMLEAGIKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 152 - protein, 441 aa, Bacillus cereus
MKGEILLKTTYVNATIATMNEQNEVIENGYIIVENDQIIDVNSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGIKVGIATDSVASNNNLDMFEEMRIATLLQKGIHQDATALPVETALSLATKGAAEVIGMKQTGSLEVGKCADFITIDPSNKPHLQPADEVLSHFVYAASGKDISDVIINGKRVVWNGECKTLDEERIIFEASRYKRGLQR

SEQ ID NO: 153 - protein, 441 aa, Bacillus cereus
MKGEILLKTTYVNATIVTMNEQNEVIENGYIIVENDQIIDVKSGEFVNDFEVDEVIDMKGKWVLPGLVNTHTHVVMSLLRGIGDDMLLQPWLETRIWPLESQFTPQIAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGNRVVWNGECKTLDEERIIFEASRYKRGLQR

SEQ ID NO: 154 - protein, 435 aa, Bacillus cereus
MKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAKYGKRPVEYAASCGLFKRPTVIAHGVVLNDNERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 155 - protein, 435 aa, Bacillus cereus
MKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKDDEKKAVEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLETGVKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKLVVWNGECKTLDEERIIFEASRYKRGLQR

SEQ ID NO: 156 - protein, 441 aa, Bacillus cereus
MKGEILLKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNENERAFLAEHDVRVAHNPNSNLKLGSGIANVKAMLEAGIKVGIATDSVASNNNLDMFEEMRIATLLQKGIHQDATALPVETALSLATKGAAEVIGMKQTGSLEVGKCADFIAIDPSNKPHLQPADEVLSHLVYAASGKDISDVIINGKRVVWNGECKTLDEERIIFEASRYKRGLQR

SEQ ID NO: 157 - protein, 441 aa, Bacillus cereus
MKGEILLKTTYVNATIVTMNEQNEVIENGYIIVENDQIIDVKSGEFANDFEVDQVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNDNERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEIGKCADFITIDPSNKPHLQPADEVLSHLVYAASGKDISDVIINGKRVVWNSECKTLDEERIIFEASRYKRGLQR

SEQ ID NO: 158 - protein, 435 aa, Bacillus sp.
MKTTYVNATIVTMNEQNEVIENGYIIVENDQIIDVKSGEFANDFAVDEVIDMKGKWVLPGLVNTHTHVVMSLLRGIGDDMLLQPWLETRIWPLESQFTPELAVASTELGLLEMVKSGTTSFSDMFNPIGVDQDAIMETVSKSGMRAAVSRTLFSFGTKDDEKKAIEEAEKYVKRYYNESGMLTTMVAPHSPYTCSAELLEECARIAVENQTMVHIHLSETEREVRDIEAQYGKRPVEYAASCGLFKRPTVIAHGVVLNENERAFLGEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 159 - protein, 441 aa, Bacillus thuringiensis
MKGEILLKTTYVNATIVTMNEQNEVIENGYIIVENDQIIDVKSGEFANDFAVDEVIDMKGKWVLPGLVNTHTHVVMSLLRGIGDDMLLQPWLETRIWPLESQFTPELAVASTELGLLEMVKSGTTSFSDMFNPIGVDQDAIMETVSKSGMRAAVSRTLFSFGTKDDEKKAIEEAEKYVKRYYNESGMLTTMVAPHSPYTCSAELLEECARIAVENQTMVHIHLSETEREVRDIEAQYGKRPVEYAASCGLFKRPTVIAHGVVLNENERAFLGEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 160 - protein, 441 aa, Bacillus cereus
MKGEILLKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAKYGKRPVEYAASCGLFKRPTVIAHGVVLNDNERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEIGKCADFITIDPSNKPHLQPADEVLSHLVYAASGKDISDVIINGKRVVWNGECKTLDEERIIFEASRYKRGLQR

SEQ ID NO: 161 - protein, 435 aa, Bacillus cereus
MKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPQIAVASTELGLLEMVKSGTTSFSDMFNPIGVDQDAIMETVSRSGMRAAVSRTLFSFGTKDDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNDDERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 162 - protein, 435 aa, Bacillus cereus
MKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAKYGKRPVEYAASCGLFKRPTVIAHGVVLNDNERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEIGKCADFITIDPSNKPHLQPADEVLSHLVYAASGKDISDVIINGKRVVWNGECKTLDEERIIFEASRYKRGLQR

SEQ ID NO: 163 - protein, 441 aa, Bacillus cereus
MKGEILLKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNDNERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEAGKCADFITIDPSNKPHLQPADEVLSHLVYAASGKDISDVIINGKHVVWNGECKTLDEERIIFEASRYKRGLQR

SEQ ID NO: 164 - protein, 441 aa, Bacillus sp.
MKGEILLKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLDDNERAFLAEHDVRVAHNPNSNLKLGSGIANVKAMLEAGMKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKHVVWNGECKTLDEERIIFEASRYKRGLQR

SEQ ID NO: 165 - protein, 441 aa, Bacillus cereus
MKGEILLKTTYVNATIVTMNEQNEVIENGYIIVENDQIIDVKSGEFANDFEVDEVIDMKGKWVLPGLVNTHTHVVMSLLRGIGDDMLLQPWLETRIWPLESQFTPELAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAKYGKRPVEYAASCGLFKRPTVIAHGVVLNDNERAFLAEHDVRVAHNPNSNLKLGSGIANVKAMLEAGIKVGIATDSVASNNNLDMFEEMRIATLLQKGIHQDATALPVETALTLATKGAVEVIGMKQTGSLEVGKCADFITIDPSNKPHLQPADEVLSHLVYAASGKDISDVIINGKRVVWNGECKTLDEERIIFEASRYKRGLQR

SEQ ID NO: 166 - protein, 441 aa, Streptococcus pneumoniae
MKGEILLKTTYVNATIVTMNEQNEVIENGYIIVENDQIIDVKSGEFASDFEVDEVIDMKGKWVLPGLVNTHTHVVMSLLRGIGDDMLLQPWLETRIWPLESQFTPQIAVASTELGLLEMVKSGTTSFSDMFNPIGVDQDAIMETVSRSGMRAAVSRTLFSFGTKEDEKKAIEEAEKYVKRYYNESGMLTTMVAPHSPYTCSTELLEECARIAVENQTMVHIHLSETEREVRDIEAQYGKRPVEYAASCGLFKRPTVIAHGVVLNDNERAFLAEHDVRVAHNPNSNLKLGSGIANVKAMLEAGIKVGIATDSVASNNNLDMFEEMRIATLLQKGIHQDATALPVETALTLATKGAAEVIGMKQTGSLEVGKCADFITIDPSNKPHLQPADEVLSHLVYAASGKDISDVIINGKRVVWNGECKTLDEERIIFEASRYKRGLQR

SEQ ID NO: 167 - protein, 464 aa, Unknown
  Bradyrhizobiaceae family
MSLIAIKNADWILTMDGARRVIADGSILIDKDRIRAIGKSAVIEIPPETTKVIDGRGKVVLPGLIDSHTHHSLHLGRGLADECDIQTFLYRRLYPIEASLNDEDAYISALLCQLEMIKSGTTSIIDAGNYFPEATLRAFGTTGMRGVVARSTFDIPTSSLGSLPAQVFAEETNVALKRAEEFVERNSGACDGRVQAWLQLRVLPNCSDELCRGLKSIADRLGVRYEAHAAFTKEVYEASKLQFGKSEVRRLDDLGILGEGLLLAHMGWLTPRDILLLISSKTNVVLCPTSSVHQAMGSIAFGHVPELLEMGVNVALGTDGGPHGTNDLVRQIFVAAGGYKEVRLDATIMPPETVLEMATVNGARAMGMSDQVGSIEPGKKADITIFDSRRPEWRPLHNPVANLVYCANGNSADTVIVDGRILMENRKILTFNEDDVITEAQRRSVEIGARAGLLEYGRPRWPVH

SEQ ID NO: 168 - protein, 342 aa, Pseudomonas sp.
MPPGCSGLCSFVGLTMPLKFSGVLCASLLTITLSVAAHATELILDFNKVQMRSQQLAPGVYAHLPADSAELNAKGGVAGTSGGLIVGTRGAMLIETMLNRRLFDQVQALAKKEALGLPLLYAVNTSYHGDHSYGNMYLKAPTRVIQSTKTRDYVDGHLADDKAFMVKNFGAGRGVEQITARTGDILVPPGGRVSVDLGGKTVEIIDFGFAQTGGDLFVWEPQSKVMWTGNAVVASKPALPWLLDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARP

SEQ ID NO: 169 - protein, 327 aa, Pseudomonas sp.
MPLKFSGVLCASLLTITLSVAAHATELILDFNKVQMRSQQLAPGVYAHLPADSAELNAKGGVAGTSGGLIVGTRGAMLIETMLNRRLFDQVQALAKKEALGLPLLYAVNTSYHGDHSYGNMYLKAPTRVIQSTKTRDYVDGHLADDKAFMVKNFGAGRGVEQITARTGDILVPPGGRVSVDLGGKTVEIIDFGFAQTGGDLFVWEPQSKVMWTGNAVVASKPALPWLLDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARP

SEQ ID NO: 170 - protein, 342 aa, Paracoccus sp.
MPPGCSGLCSFVGLTMPLKFSGVLCASLLTITLSVAAHATELILDFNKVQMRSQQLAPGVYAHLPADSAELNAKGGVAGTSGGLIVGTRGAMLIETMLNRRLFDQVQALAKKEALGLPLLYAVNTSYHGDHSYGNMYLKAPTRVIQSTKTRDYVDGHLADDKAFMVKNFGAGRGVEQITARTGDILVPPGGRVSVDLGGKTVEIIDFGFAQTGGDLFVWEPQSKVMWTGNAVVASKPALPWLLDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARI

SEQ ID NO: 171 - protein, 342 aa, Rhodococcus sp.
MPPGCSGLCSFVGLTMPLKFSGVLCASLLTITLSVAAHATELILDFNKVQMRSQQLAPGVYAHLPADSAELNAKGGVAGTSGGLIVGTRGAMLIETMLNRRLFDQVQALAKKEALGLPLLYAVNTSYHGDHSYGNMYLKAPTRVIQSTKTRDYVDGHLADDKAFMMKNFGAGRGVEQITARTGDILVPPGGRVSVDLGGKTVEIIDFGFAQTGGDLFVWEPQSKVMWTGNPVVASKPALPWLLDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARP

SEQ ID NO: 172 - protein, 327 aa, Rhizobium sp.; identical to SEQ ID NO: 169

SEQ ID NO: 173 - protein, 327 aa, Ochrobactrum lupine
MPLKFSGVLCASLLTITLSVAAHATELILDFNKVQMRSQQLAPGVYAHLPADSAELNAKGGVAGTSGGLIVGTRGAMLIETMLNRRLFDQVQALAKKEALGLPLLYAVNTSYHGDHSYGNMYLKAPTRVIQSTKTRDYVDGHLADDKAFMVKNFGAGRGVEQITARTGDILVPPGGRVSVDLGGKTVEIIDFGFAQTGGDLFVWEPQSKVMWTGNSVVASKPALPWLLDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARP

SEQ ID NO: 174 - protein, 327 aa, Bordetella sp.
MPLKFSGVLCASLLTITLSVAAHATELILDFNKVQMRSQQLAPGVYAHLPADSAELNAKGGVAGTSGGLIVGTRGAMLIETMLNRRLFDQVQALTKKEALGLPLLYAVNTSYHGDHSYGNMYLKAPTRVIQSTKTRDYVDGHLADDKAFMVKNFGAGRGVEQITARTGDILVPPGGRVSVDLGGKTVEIIDFGFAQTGGDLFVWEPQSKVMWTGNAVVASKPALPWLLDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARP

SEQ ID NO: 175 - protein, 327 aa, Shinella sp.
MPLKFSGVLCASLLTITLSVAAHATELILDFNKVQMRSQQLAPGVYAHLPADSAELNAKGGVAGTSGGLIVGTRGAMLIETMLNRRLFDQVQALAKKEALGLPLLYAVNTSYHGDHSYGNMYLKAPTRVIQSTKTRDYVDGHLADDKAFMVKNFGAGRGVEQITARTGDILVPPGGRVSVDLGGKTVEIIDFGFAQTGGDLFVWEPQSKVMWTGNPVVASKPALPWLLDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARP

SEQ ID NO: 176 - protein, 327 aa, Ochrobactrum sp.
MPLKFLGVLCASLLTITLSVAAHATELILDFNKVQMRSQQLAPGVYAHLPADSAELNAKGGVAGTSGGLIVGTRGAMLIETMLNRRLFDQVQALAKKEALGLPLLYAVNTSYHGDHSYGNMYLKAPTRVIQSTKTRDYVDGHLADDKAFMVKNFGAGRGVEQITARTGDILVPPGGRVSVDLGGKTVEIIDFGFAQTGGDLFVWEPQSKVMWTGNAVVASKPALPWLLDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARP

SEQ ID NO: 177 - protein, 327 aa, Lysobacter ruishenii
MPLKFSGVLCASLLTITLSVAAHATELILDFNKVQMRSQQLAPGVYAHLPADSAELNAKGGVAGTSGGLIVGTRGAMLIETMLNRRLFDQVQALAKKEALGLPLLYAVNTSYHGDHSYGNMYLKAPTRVIQSTKTRDYVDGHLADDKAFMVKNFGAGRGVEQITARTGDILVPPGGRVSVDLGGKTVEIIDFGFAQTGGDLFVWEPQSKVMWTGNAVVASKPALPWLPDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARP

SEQ ID NO: 178 - protein, 327 aa, Caulobacter sp.
MPLKFLGVLCASLLTITLSVAAHATELILDFNKVQMRSQQLAPGVYAHLPADSAELNAKGGVAGTSGGLIVGTRGAMLIETMLNRRLFDQVQALAKKEALGLPLLYAVNTSYHGDHSYGNMYLKAPTRVIQSTKTRDYVDGHLADDKAFMVKNFGAGRGVEQITARTGDILVPPGGRVSVDLGGKTVEIIDFGFAQTGGDLFVWEPQSKVMWTGNSVVASKPALPWLLDGKLVETLATLQKVYDFLPPDATIVPGHGVPMAREGLRWHLDYLAAVQAGVKDALARKLSLEQTVTELKMPEFRGYVLFDWVHPDLNVPAAYKDLAARP

SEQ ID NO: 179 - protein, 211 aa, Escherichia coli
MRHLCPDFYGATYEKMGELGFIQWPCRDTSDADQGTSYLFKEKFDTPNGLAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 180 - protein, 173 aa, Escherichia coli
MFKEKFDTPNGKAQFFTCDWVAPIDKLTDEYPMVLSTVREVGHYSCRSMTGNCAALAALADEPGYAQINTEDAKRLGIEDEALVWVHSRKGKIITRAQVSDRPNKGAIYMTYQWWIGACNELVTENLSPITKTPEYKYCAVRVEPIADQRAAEQYVIDEYNKLKTRLREAALA

SEQ ID NO: 181 - protein, 166 aa, Escherichia coli
MNRFIMANSQQCLGCHACEIACVMAHNDEQHVLSQHHFHPRITVIKHQQQRSAVTCHHCEDAPCARSCPNGAISHVDDSIQVNQQKCIGCKSCVVACPFGTMQIVLTPVAAGKVKATAHKCDLCAGRENGPACVENCPADALQLVTDVALSEPPRKSWRLNSLRKR

SEQ ID NO: 182 - protein, 759 aa, Bacillus thuringiensis
MTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVASKLGSIKEEYGKDAIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHNQEFINENVNFFEDFKESLKEYTLEYGEEMTGISKETLIQMAEMIRDADGTCILWGMGVTQNTGGSDTSAAISNLLLATGNYRRPGAGAYPLRGHNNVQGACDMGTLPGWLPGYQHVTNEMERAKFETAYGVKIDSEPGLNNIEMLHAIDEGKMKAMYLVGEDMALVDSNANHVHEVLTSLDFFVVQDVFLSKTAQYADVVLPAAPSLEKEGTFTNTERRVQRLYQVLPTLGDAKPDWWIVQEVANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEISPDLAKERGVKTGSLVRLVSPFGALKLRALVTDRVKANELYLPMNSTDNETAINFLTGPAVDVRTNTPAYKQTKVRMEVLEVDGENPMPKANPRNKKRHPQAGIEVHRKWARTGYVHLTDK

SEQ ID NO: 183 - protein, 975 aa, Bacillus thuringiensis
MVHITIDGKKYTAEPGSTILGVMNENGIEHPQICYVPEVDPIQTCDTCIVEVDGKLMRSCSTIATEGMSIERASVRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGAIKEEYGKGSIGFISSSKITNEDNYVIQKLARQVFGTNNIDNCSRYCQSPATDGLFRTIGMGGDAGTIKDIAQSGLVIIVGCNPTEGHPVLATRIKRAHKLHGQKLIVADLRKTEMVERSDVFISPKQGTDQVWLMAVTKYMIDQGWHNQEFINENVNFFEDFKESLEEYTLEYAEEVTGISKETLIQMAEMIRDADGTCILWGMGVTQNTGGSDTSAAISNLLLATGNYRRPGAGAYPLRGHNNVQGACDMGTLPGWLPGYQHVTNEMERAKFETAYGVKIDSEPGLNNIEMLYASDEGKMKAMYLVGEDMALVDSNANHVHEVLSSLDFFVVQDVFLSKTAQYADVVLPAAPSLEKEGTFTNTERRVQRLYQVLPTLGDAKPDWWIVQEVANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEISPDLAKERGVKTGSLVRLVSPFGALKLRALVTERVKANELYLPMNSTDNETAINFLTGPAVDTRTNTPAYKQTKVRMEVLEVDGENPMPKANPRNKKRHPQAGIEVHRKWARPGYVHLTDK

SEQ ID NO: 184 - protein, 979 aa, Bacillus thuringiensis
MNDNMVHITIDGKKYTAEPGSTILGVINENGIEHPQICYVPEVDPIQTCDTCIVEVDGKLMRSCSTIATEGMNVERASVRAKEAQTEAMDRLLENHLLYCTVCDNNNGNCKLHNTAELMEIEHQKYPYEPKVDVSEVDMTHPFYRYDPNQCIACGQCVEVCQNLQVNETLSIDWEAERPRVIWDEGVNINDSSCVSCGQCVTICPCNALMEKTMLGEAGFMTGLKPDILEPMVDLIKEVEPGYSGIFAVSEVEAAMRDTRTKKTKTVCTFCGVGCSFEVWTKGRKILKVQPSSDAPVNAISTCVKGKFGWDFVNSKERITKPLIRKNGTFVESTWEEALNVVANKLGTIKEEYGKGSIGFISSSKITNEDNYVIQKLARQVFETNNIDNCSRYCQSPATDGLFRTIGMGGDAGTIKDIAQSGLVIIVGCNPTEGHPVLATRIKRAHKLHGQKLIVADLRKTEMAERSDVFISPKQGTDQVWLMAVTKYMIDQGWHDQEFINENVNFFEDFKESLKEYTLEYGEEMTGISKETLIQMAEMIRDADGTCILWGMGVTQNTGGSDTSAAISNLLLATGNYRRPGAGAYPLRGHNNVQGACDMGTLPGWLPGYQHVTNEMERAKFETAYGVKIDSEPGLNNIEMLHAIDEGKMKAMYLVGEDMALVDSNANHVHEVLTSLDFFVVQDVFLSKTAQYADVVLPAAPSLEKEGTFTNTERRVQRLYQVLPTLGDAKPDWWIVQEVANKLGANWNYSHPSEIFAEMASLSPLFSQANYEVLEGWNSFHWGSFDGTNTPLLFQDGFNFPDKKARFAIADWVRPAEFPAEFDLHINNGRMLEHFHEGNMTNKSTGIQTKVPGVFVEISPDLAKERGVKTGSLVRLVSPFGALKLRALVTDRVKANELYLPMNSTDNETAINFLTGPAVDVRTNTPAYKQTKVRMEVLEVDGENPMPKANPRNKKRHPQAGIEVHRKWARTGYVHLTDK

SEQ ID NO: 185 - protein, 249 aa, Escherichia coli
MNHSVPSMNTPLNGKVAAITGAASGIGLQCAKTLLDAGAKVVLIDREGDKLHKIVAELGENAYALQLDLFNNQQVDNMLADIIELAGGLDIFHANAGAYIGGPVAEGDPDVWDRVLNLNINAAFRCVRAVLPHMIAQRSGDIIFTSSIAGVVPVIWEPIYTASKFAVQAFVHTTRRQVSQYGVRVGAVLPGPVVTALLDDWPKAKMEEALANGSLMQPIEVTESVLFMVTRSKNVTVRDLVILPGSVDL

SEQ ID NO: 186 - protein, 796 aa, Escherichia coli
MAINNTGSRRLLVTLTALFAALCGLYLLIGGGWLVAIGGSWYYPIAGLVMLGVAWMLWRSKRAALWLYAALLLGTMIWGVWEVGFDFWALTPRSDILVFFGIWLILPFVWRRLVIPASGAVAALVVALLISGGILTWAGFNDPQEINGTLSADATPAEAISPVADQDWPAYGRNQEGQRFSPLKQINADNVHNLKEAWVFRTGDVKQPNDPGEITNEVTPIKVGDTLYLCTAHQRLFALDAASGKEKWHYDPELKTNESFQHVTCRGVSYHEAKAETASPEVMADCPRRIILPVNDGRLIAINAENGKLCETFANKGVLNLQSNMPDTKPGLYEPTSPPIITDKTIVMAGSVTDNFSTRETSGVIRGFDVNTGELLWAFDPGAKDPNAIPSDEHTFTFNSPNSWAPAAYDAKLDLVYLPMGVTTPDIWGGNRTPEQERYASSILALNATTGKLAWSYQTVHHDLWDMDLPAQPTLADITVNGQKVPVIYAPAKTGNIFVLDRRNGELVVPAPEKPVPQGAAKGDYVTPTQPFSELSFRPTKDLSGADMWGATMFDQLVCRVMFHQMRYEGIFTPPSEQGTLVFPGNLGMFEWGGISVDPNREVAIANPMALPFVSKLIPRGPGNPMEQPKDAKGTGTESGIQPQYGVPYGVTLNPFLSPFGLPCKQPAWGYISALDLKTNEVVWKKRIGTPQDSMPFPMPVPVPFNMGMPMLGGPISTAGNVLFIAATADNYLRAYNMSNGEKLWQGRLPAGGQATPMTYEVNGKQYVVISAGGHGSFGTKMGDYIVAYALPDDVK

SEQ ID NO: 187 - protein, 794 aa, Escherichia coli
MAINNTGSRRLLVTLTALFAALCGLYLLIGGGWLVAIGGSWYYPIAGLVMLGVAWMLWRSKRAALWLYAALLLGTMIWGVWEVGFDFWALTPRSDILVFFGIWLILPFVWRRLVIPASGAVAALVVALLISGGILTWAGFNDPQEINGTLSADATPAEAISPVADQDWPAYGRNQEGQRFSPLKQINADNVHNLKEAWVFRTGDVKQPNDPGEITNEVTPIKVGDTLYLCTAHQRLFALDAASGKEKWHYDPELKTNESFQHVTCRGVSYHEAETASPEVMADCPRRIILPVNDGRLIAINAENGKLCETFANKGVLNLQSNMPDTKPGLYEPTSPPIITDKTIVMAGSVTDNFSTRETSGVIRGFDVNTGELLWAFDPGAKDPNAIPSDEHTFTFNSPNSWAPAAYDAKLDLVYLPMGVTTPDIWGGNRTPEQERYASSILALNATTGKLAWSYQTVHHDLWDMDLPAQPTLADITVNGQKVPVIYAPAKTGNIFVLDRRNGELVVPAPEKPVPQGAAKGDYVTPTQPFSELSFRPTKDLSGADMWGATMFDQLVCRVMFHQMRYEGIFTPPSEQGTLVFPGNLGMFEWGGISVDPNREVAIANPMALPFVSKLIPRGPGNPMEQPKDAKGTGTESGIQPQYGVPYGVTLNPFLSPFGLPCKQPAWGYISALDLKTNEVVWKKRIGTPQDSMPFPMPVPVPFNMGMPMLGGPISTAGNVLFIAATADNYLRAYNMSNGEKLWQGRLPAGGQATPMTYEVNGKQYVVISAGGHGSFGTKMGDYIVAYALPDDVK

SEQ ID NO: 188 - protein, 261 aa, Bacillus megaterium
MYTDLKDKVVVITGGSTGLGRAMAVRFGQEEAKVVINYYNNEEEALDAKKEVEEAGGQAIIVQGDVTKEEDVVNLVQTAIKEFGTLDVMINNAGVENPVPSHELSLDNWNKVIDTNLTGAFLGSREAIKYFVENDIKGNVINMSSVHEMIPWPLFVHYAASKGGMKLMTETLALEYAPKGIRVNNIGPGAMNTPINAEKFADPVQRADVESMIPMGYIGKPEEVAAVAAFLASSQASYVTGITLFADGGMTKYPSFQAGRG

SEQ ID NO: 189 - protein, 465 aa, Bacillus campisalis
MRKLKVGLRPIARNINLPTVIKTAVIPGDSMERLFIATQVGEIFYIGDSGLRLFLDIRPRIIKLGASRGGYDERGLLGLAFHPEFYYNGLFYLHYSAAGTQGPGALPDSFQPNPCDPPSLNLRWTNRETQFDHIDTVEEWVHLPNGEPRKRRTLLHLRRPFFNHNGVNSLTFSPETGRLVLTTGDGGSGFDPFNLSQDNLEIAGKIIEIDVRKNPSNGDPPIVTRFDELPSAIQATLTVIAKGVRNIPGISYQRFHNQFIKYAGNVGQELIESIFSFTHYQPVPVPLLAQASSMNTKGLINFGWRGWEGGLPALVPRACTENQALDEKIMAFYQEAVSLASCRLHPLTSYYHQDARAGKFAGTALTGVQAYMGRNIPGLTGSVVFTDFARKYSKPVRGALAYTSVKPNGKQNDFHEIQIDYEFGNQPAHFVSLGTDLNQTRLFLGVYGSARVTDLNQGGVFEILP

SEQ ID NO: 190 - protein, 476 aa, Bacillus thuringiensis
MTKVKVSLRPIVHNINLPTVLKTTILPGESTERLFIATQLGEIFYIGNGVIKIFLDIRHLIIKLGTFEEGVSSSGYDERGLLGLAFHPQFYQNGLFYLHYSVAGTQGPGAFSEQFKPNPCDPKTLNLKWVNRNTQYDHIDTVEEWTLQSNGQAQKRRTLLNVRRPFFNHNGVNSLNFSPETGKLVFTNGDGGSGYDPFNLSQDDLEIAGKIIEIDVSKNTFINNPPVVTRFNELPLSIQETLTVIAKGVRNITGISFQRFYNQYIKYAGNVGQNIVESIFSFVQYKPIPVTELVQMHFMRLTPNQDGFINFGWRGWEGDLPTSFIRHCSENQTLDERTMTYYDETIQTSARRILPLLSYFHQDSRPDKFGGTSLTGVQPYMGNAIPNLTGSVVFTDLAKKEDSRPPVKGVLAYTRAGTDGKHADFHAIETNYDFGTQAAYYMSLGTNLNQTKLYLGVYGSMKVTDFNKGTIFEIIP

SEQ ID NO: 191 - protein, 373 aa, Escherichia coli
MPPSTFGAICKGLGEAKLNAKPARVVMEKPLGTSLATSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 192 - protein, 491 aa, Escherichia coli
MAVTQTAQACDLVIFGAKGDLARRKLLPSLYQLEKAGQLNPDTRIIGVGRADWDKAAYTKVVREALETFMKETIDEGLWDTLSARLDFCNLDVNDTAAFNRLGAMLDQKNRITINYFAMPPSTFGAICKGLGEAKLNAKPARVVMEKPLGTSLGTSQEINDQVGEYFEECQVYRIDHYLGKETVLNLLALRFANSLFVNNWDNRTIDHVEITVAEEVGIEGRWGYFDKAGQMRDMIQNHLLQILCMIAMSPPSDLSADSIRDEKVKVLKSLRRIDRSNVREKTVRGQYTAGFAQGKKVPGYLEEEGANKSSNTETFVAIRVDIDNWRWAGVPFYLRTGKRLPTKCSEVVVYFKTPELNLFKESWQDLPQNKLTIRLQPDEGVDIQVLNKVPGLDHKHNLQITKLDLSYSETFNQTHLADAYERLLLETMRGIQALFVRRDEVEEAWKWVDSITEAWAMDNDAPKPYQAGTWGPVASVAMITRDGRSWNEFE

SEQ ID NO: 193 - protein, 373 aa, Escherichia coli; identical to SEQ ID NO: 191

SEQ ID NO: 194 - protein, 496 aa, Bacillus indicus
MNTEHKPKAVIVIFGATGDLAKRKLFPSIYRLHRSKKIDSDFAVVGVGRRPWTNEEFRSNVSDSIQSSIKQSSELDEFASHFYYHPFDVTNPSSYLELKGMLSDLDGKYGIPGNRMFYMAMAPEFFGTIARNLKSEGLTATEGWSRLVIEKPFGHDLPSAQELNDEIREAFSEDQIYRIDHYLGKQMVQNIEVIRFSNALFESVWNNRYISNIQVTSSEVLGVEDRGRYYENSGALRDMVQNHLMQMVALLAMEPPIKLETDEIRSEKVKVMRALRPLTEKDVPDYFVRGQYGKGESEEVSVPGYREESNVDPESNTETYVAGKLMIDNFRWAGVPFYIRTGKRMTAKSTKIVVQFKDLPMNLYSNDVDSKHPNLLVIHIQPDEGITLHLNAKEAGGGSYVKPIKLDYCSNCVDQFNTPEAYEKLIYDGLRGDATNFTHWDEVSLSWSYVDTISKAWETHKAEFPNYAAGTMGPKAADELLEKDGFHWWPITDMVD

SEQ ID NO: 195 - protein, 484 aa, Bacillus megaterium
MDSMTFVLFGATGDLAKRKIYPALFNLYLNQKLPKSFSIIGVGRHNITDSEFQSRVVDSLYTFSRHLINDKSKKEAFAKAFHYCQLDFTNTEGYKKLLELVQQNEKDQNIEENRMFYLSVAPEFFDVIAMNIRDSELGTTKGWKRLIIEKPFGHDVKSAQELNEKLSRAFEEDEIYRIDHYLGKPMVQNLEALAFANPVLQSLWNNRFIANVQITASEIVGVEERAGYYDKAGAIRDMVQNHMLQLLMMTAMHLPKRITANEIRKEKRKVLESLRPLQRDTVGVHVVRGQYGAGEINGSPVAAYKEEPGVDAFSQNDTFIAARLWIDNSFWDGVPFYICTGKRMAEKATKIVIEFKNPLKDSYPSEMEQIEPNLLTININPNEGVSLRLNSKNPINGEMEPITVDFSASKQDVPEAYELLLFDALVGDSTFFAHWNEVELSWNWVEPILEAFKENRVPLHSYSSGSMGPEAAHQLLEKDGYKWW

SEQ ID NO: 196 - protein, 506 aa, Bacillus thuringiensis
MKNYTTPKCIIVIFGATGDLAKRKLFPSLFRLFRQRKISENFAVVGVARRPLSTEEFRENVKQSIHNLQEENMTHDTFASHFYYHPFDVTNLSSYQELKSLLITLDGRYFTEGNRMFYLAMAPDFFGTIATNLKSEGLTSTEGWIRLVIEKPFGHDYESAQALNDQIRHAFTEDEIYRIDHYLGKEMVQNIKVIRFANAIFEPLWNNQYIANIQITSSETLGVEERGRYYEDSGALRDMVQNHMLQMVALLAMEPPIKLTANEIRSEKVKVLRALQPLSEETVEHNFVRGQYGPGMIDEEKVISYREENAVDSDSNTETFVSGKLMIEDFRWSGVPFYIRTGKRMQEKSTEIVIQFKDLPMNLYFNKEKKVHPNLLVIHIQPEEGITLHLNAQKTDSGTTSTPIQLSYCNNCMDKMNTPEAYQVLLYDCMRGDSTNFTHWDEVCLSWKFVDTISSVWRNKPAKHFPNYESGSMGPKESDALLERDRFHWWPTITSHLKGESYNENI

SEQ ID NO: 197 - protein, 372 aa, Escherichia coli
MARYYFSCPKIYFGEEAITSLCQFNNKRVGIVTDDFMMSSGKTRYLISHMPEASVCIFGEVTPDPDIDILTSGAARFKAFKPDVIIALGGGSSLDAAKGIKVTLEEYFGDHQIDLIAIPTTSGSGSEVTSYAIISDPQNGRKYPLISGQLVPEIAILDPNLVLTAPRHVAVDTGMDVLTHAIEAFVSTGSNDFSDALAEKAIALTWRYLPQVFNDEKDIAARTHMHNASCMAGMAFNSAGLGLVHGMAHAIGGMLHIPHGKINAMLLPIVIDFNSKRASTETRDRYHRCAQIIGIDHAVPEQPIALMTQEIRQINRHFCIPVTLSELGIDRAKIIELRSALVNSTLADGCTASNPRQVTTHDVEGLIDLITG

SEQ ID NO: 198 - protein, 347 aa, Escherichia coli
MKNSKAILQVPGTMKIISAEIPVPKEDEVLIKVEYVGICGSDVHGFESGPFIPPKDPNQEIGLGHECAGTVVAVGSRVRKFKPGDRVNIEPGVPCGHCRYYLEGKYNICPDVDFMATQPNYRGALTHYLCHPESFTYKLPDNMDTMEGALVEPAAVGMHAAMLADVKPGKKIIILGAGCIGLMTLQACKCLGATEIAVVDVLEKRLIMAEQLGATVVINGTKEDTIARCQQFTEDMGADIVFETAGSAVTVKQAPYLVMRGGKIMIVGTVPGDSAINFLKINREVTIQTVFRYANRYPVTIEAISSGRFDVKSMVTHIYDYRDVQQAFEESVNNKRDIIKGVIKISD

SEQ ID NO: 199 - protein, 335 aa, Escherichia coli
MKALARFGKAFGGYKMIDVPQPMCGPEDVVIEIKAAAICGADMKHYNVDSGSDEFNSIRGHEFAGCIAQVGEKVKDWKVGQRVVSDNSGHVCGVCPACEQGDFLCCTEKVNLGLDNNTWGGGFSKYCLVPGEILKIHRHALWEIPDGVDYEDAAVLDPICNAYKSIAQQSKFLPGQDVVVIGTGPLGLFSVQMARIMGAVNIVVVGLQEDVVARCQQICGKDNLGLVIECSGANIALKQAIEMLRPNGEVVRVGMGFKPLDFSINDITAWNKSIIGHMAYDSTSWRNAIRLLASGAIKVKPMITHRIGLSQWREGFDAMVDKTAIKVIMTYDFDE

SEQ ID NO: 200 - protein, 378 aa, Bacillus halodurans
MKAVTYQGIKDVKVKEVPDPKLEKKDDVLVRITSTAICGSDLHLVHGMIPNFPKGYIIGHEPMGIVEEVGPDVTKVKKGDRVIVPFNIACGKCYYCTHDLESQCDNSNPNGQAGAYFGYSGTFGGYPGGQAELLRVPYGNFTPFVVPEDAEMEDEKLLFLSDIIPTAYWGVEQAEVKKGDTVVVLGCGPVGLLAQKFAWLKGAERVIAVDYVQYRLTHAKQTNQVEVLDFSTIDDVGTHIKEITKGGADSVIDCVGMDGKKSAVEMVETALKLQGGTLGPINIASQAVRKGGTVSIVGVYGTRYNAFPLGDFFARNITLKMGQAPIIHYMPTLYQMIKDEVFDPTDLITHRLPLELAEHGYDIFDAKQDDCIKVVLKP

SEQ ID NO: 201 - protein, 866 aa, Bacillus licheniformis
MAIEEKNMKQKQNASNMIDQLVEKGLKALEEFRSFDQEQIDEIVKQMALAGLDQHMPLAKLAVEETKRGVYEDKIIKNMFATEYVYHHIKYDKTVGIINENEHDGVIEIAEPVGVIAGVTPVTNPTSTTMFKSLISIKTRNPIVFAFHPSAQKCSREAARILRDAAVKAGAPDNCIQWIETPSLDATQALMTHPNVSLILATGGAGMVKSAYSSGKPALGVGPGNVPCYIEKSANLKQAVNDLILSKTFDNGMICASEQAVIIDKGIYSDVKAEMTRNNCYFLNKTEKSKVEKLVINENTCAVNADIVGMPAFKIAEMAGIKVPQDTKILIAELEGVGPDDPLSREKLSPVLACYKVSGLEEGLKRAEEMLAFGGTGHSAVIHTNDQEAVKEFGLRMKAGRIIVNAPSSQGAIGDIYNAYMPSLTLGCGTYGGNSVSSNVGAVHLINTKKVAKRNVNMQWFKVPPKIYFEKHATQYLAKMPDISKAFIVTDPGMVKLGYVDRALHYLRRRPDYVHCEIFSDVEPDPSIETVMNGVDMMAKFQPDVIIALGGGSAMDAAKGMWMFYEHPDAEFFGLKQKFLDIRKRIVKYPKLGGKAKFVAIPTTSGTGSEVTSFSVITDKETNTKYPLADYELTPDVAIIDPQFMTVPKHITADTGMDVLTHAIESYVSCMANDYTDGLAMKAIQLIFEYLPRAYKNGSDELAREKVHNASTIAGMAFSNAFLGINHSLAHKLGAEFQIAHGRANAILLPHVIRYNAAKPKKFTAFPKYSHFIADQRYAEIARTLGLPAKTTAEGVESLIQEIISLAKELKIPMSIKQNGVDAAAFESKVDLMAERAFEDQCTTANPKLPLVSELAEIYRSAYKGV

SEQ ID NO: 202 - protein, 371 aa, Bacillus megaterium
MVAIKKEVEKGKQAPAGFMKAVVYQGHKQVGLQYKEIPKAEAGEVVIKTTSTTICGTDIHILHDEHKVEKNRTLGHEHVGVVHEVGEGVTGIKVGERVMCGSCTPCGSCYYCQKNLSSQCIGPEGDFKTPGGWRLGNTIDGTHAEYFKMPFPQYNLTKIPDELSDEDVLLLTDIASTGIAAAENAQIQIGDIVAVFACGPVGLCSIAGARLKGASLIIGIDGNYQRLGLAKKMGADVTLNFNEVNVVEEIMKLSGNKGIEVAIEALGKEETFQQCLKVIRRGGCISSVGVYSGHVEIPIEHFASGMGDHRIVTTLCPGGRERMQQLMSLVIQERMDLKPMITHRFTIDEAIEAYRLFEHAEDQIIKPIITF

SEQ ID NO: 203 - protein, 447 aa, Escherichia coli
MDQTYSLESFLNHVQKRDPNQTEFAQAVREVMTTLWPFLEQNPKYRQMSLLERLVEPERVIQFRVVWVDDRNQVQVNRAWRVQFSSAIGPYKGGMRFHPSVNLSILKFLGFEQTFKNVLTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLAQGVI

SEQ ID NO: 204 - protein, 242 aa, Escherichia coli
MRPEATGYGLVYFTEAMLKRHGMGFEGMRVSVSGSGNVAQYAIEKAMEFGARVITASDSSGTVVDESGFTKEKLARLIEIKASRDGRVADYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLSQGVI

SEQ ID NO: 205 - protein, 388 aa, Escherichia coli
MIQFRVVWVDDRNQVQVNRAWRVQFSSAIGPYKGGMRFHPSVNLSILKFLGFEQTFKNALTTLPMGGGKGGSDFDPKGKSEGEVMRFCQALMTELYRHLGADTDVPAGDIGVGGREVGFMAGMMKKLSNNTACVFTGKGLSFGGSLIRPEATGYGLVYFTEAMLKRHGMGFEGMRVSVSGSGNVAQYAIEKAMEFGARVITASDSSGTVVDESGFTKEKLARLIEIKASRDGRVTDYAKEFGLVYLEGQQPWSVPVDIALPCATQNELDVDAAHQLIANGVKAVAEGANMPTTIEATELFQQAGVLFAPGKAANAGGVATSGLEMAQNAARLGWKAEKVDARLHHIMLDIHHACVEHGGEGEQTNYVQGANIAGFVKVADAMLSQGVI

SEQ ID NO: 206 - protein, 430 aa, Bacillus halodurans
MTILKEPQRTQVDEIKEITELSLLQSTQSVIKEALDLLGYSEATYELLKEPIRMLTVRIPVRMDDGNVNIFTGYRAQHNDAVGPTKGGVRFHPDVNENEVKALSLWMSLKCGIADLPYGGGKGGIICDPRTMSFGELERLSRGYVRAISQIVGPTKDIPAPDVFTNSQVMAWMMDEYSRIREFDSPGFITGKPIVLGGSLGRESATAKGVIICIEEAAKRNQLDLKGARVIIQGFGNAGSFLAKFLHDAGALIVGISDAYGALYDQAGLDIEYLLDKRDSFGTVTNLFKKTISNQELLISDCDILVPAAISNQITKENAHDIKAKVVVEAANGPTTLEATRILTERGIFLVPDVLASSGGVTVSYFEWVQNNQGYYWNEEEIDQKFRNMIVGSFEKVCTFSNQHQVDMRLAAYTVGVKRMAEASHFRGWV

SEQ ID NO: 207 - protein, 464 aa, Bacillus halodurans
MDRKETAKLMENVMTELSEKEGFLGIEDDEKRKRIVLSAQEILTTTDKIIKSYIRVSTEHGIMRIPAYRVQHNNISGFYKGGIRFSEFVSEEEVENLAILMTLKNALHRLPFGGAKGGVHVDPRKYSEKELNLISKKYVQRFARDLGPNHDIPAPDLGTNEQVIDWMVGEFKTIHPGQAYLGSFTGKSVENGGARGRREATGKGTFLSYIWLLSQWYDEHVSGNGINRTKQWETISNLKQQADNSDPIRVAVQGFGNVGSVAALEAYQCSEIAHRVVAVSDRYTTLYNEKGLDVRALAAYTIGGKDLPKNSEELAAAGVEASVLPVDAVLTCETDVLILAAIENQIHERNMKQVNARVLVEGANAPISTEADDYFEAAGTVVIPDILANAGGVIVSYLEWKQSRITELYSEDDILDEMGTQMKETLKSVYERYFSSVGHTLRFTCFTLALERLTSLLYKHGKLY

SEQ ID NO: 208 - protein, 428 aa, Bacillus velezensis
MSANPISKSNQKDEEKEVLNLFLSTQSIIKEALRKLGYPDNMYELMKEPMRLLTVRIPVKMDNGSVQVFTGYRSQHNDAVGPTKGGVRFHPEVSEEEVKALSIWMTLKCGITNLPYGGGKGGIICDPRTMSFGELERLSRGYVRAISQIVGPTKDIPAPDVYTNSQIMAWMMDEYSRLREFDSPGFITGKPIVLGGSQGRETATAQGVTICIEEAVKKKGIPLENARIIIQGFGNAGSFLAKFMHDAGAKVIGISDAHGALYDPDGLDIDYLLDKRDSFGTVTNLFSDVITNRELLEKDCDILVPAAISNQITAENAHHIKASIIVEAANGPTTIDATKILNERGVLLVPDILASAGGVTVSYFEWVQNNQGFYWSEEEVAGKLRSVMVNSFESIYQTAHTHKVDMRLAAYMTGIRKSAEAARFRGWV

SEQ ID NO: 209 - protein, 400 aa, Escherichia coli
MSSKLVLVLNCGSSSLKFAIIDAVNGEEYLSGLAECFHLPEARIKWKMDGNKQEAALGAGAAHSEALHFIVNTILAQKPELSAQLTAIGHRIVHGGEKYTSSVVIDESVIQGIKDAASFAPLHNPAHLIGIEEALKSFPQLKDKNVAVFDTAFHQTMPEESYLYALPYNLYKEHGIRRYGAHGTSHFYVTQEAAKMLNKPVEELNIITCHLGNGGSVSAIRNGKCVDTSMGLTPLEGLVMGTRSGDIDPAIIFHLHDTLGMSVDAINKLLTKESGLLGLTEVTSDCRYVEDNYATKEDAKRAMDVYCHRLAKYIGAYTALMDGRLDAVVFTGGIGENAAMVRELSLGKLGVLGFEVDHERNLAARFGKSGFINKEGTRPAVVIPTNEELVIAQDASRLTA

SEQ ID NO: 210 - protein, 277 aa, Escherichia coli
MNEFPVVLVINCGSSSIKFSVLDASDCEVLMSGIADGINSENAFLSVNGGEPAPLAHHSYEGALKAIAFELEKRNLNDSVALIGHRIAHGGSIFTESAIITDEVIDNIRRVSPLAPLHNYANLSGIESAQQLFPGVTQVAVFDTSFHQTMAPEAYLYGLPWKYYEELGVRRYGFHGTSHRYVSQRAHSLLNLAEDDSGLVVAHLGNGASICAVRNGQSVDTSMGMTPLEGLMMGTRSGDVDFGAMSWVASQTNQSLGDLERVVNKESGLLGKVRTSP

SEQ ID NO: 211 - protein, 170 aa, Escherichia coli
MRKEMNEFPVVLVINCGSSSIKFSVLDASDCEVLMSGIADGINSENAFLSVNGGEPAPLAHHSYEGALKAIAFELEKRNLNDSVALIGHRIAHGGSIFTESAIITDEVIDNIRRVSPLAPLHNYANLSGIESAQQLFPGVTQVAVFDTSFHQTMAPEAYLYGLPVVTPTY

SEQ ID NO: 212 - protein, 391 aa, Bacillus halodurans
MAINAGSSSLKFQLLNMPEEELVTKGVVERIGLGDGIFTIEVKGEKVTETFDIPDHAFAVKTLLEKLTSHEIIQSLDEIEGIGHRVVHGGEKFNDSVLITDEVIQGIEECNELAPLHNPANIVGIRAFKEVLPNVPAVAVFDTAFHQTMPESSFLYSLPYDYYKEFGIRKYGFHGTSHKYVSQRAAELLGRPIEQLRLLSCHLGNGASIAAIDGGKSIDTSMGFTPLAGVTMGTRSGNIDPALIPFIMEKTGQTANEVINTLNKKSGLLGVSGFSSDLRDIEEQAGEGNDRAELALEVFTSRIHKYIGSYAARMSGVDAIIFTAGIGENSTVIRERVLRGLEFMGVYWDPSLNQVRGKEAFINYPHSPVKVLVIPTNEEVMIARDTVRLAQ

SEQ ID NO: 213 - protein, 395 aa, Bacillus indicus
MAKVIAINAGSSSLKFQLFEMPAETVLTAGLVERIGLDNAVFTISVNGEKQTETTEIPDHAVAVKILLSKLTDLGIIQSLDEIEGIGHRVVHGGEKFDDSVLITPETLAQIEELSELAPLHNPANVVGIKAFKEVLPNVPAVAVFDTAFHQTMPDQSFLYSLPYEYYEKFGIRKYGFHGTSHKYVSERAAELLGRPIEQLRLISCHLGNGASIAAIEGGKSIDTSMGFTPLAGVAMGTRSGNIDPALIPFIMEKTGHSAIEVLDILNKKSGLLGISGLSSDLRDITKAAEEGNDRARTSLEVFASRIHKYIGSYAARMSGVDAIIFTAGIGENSIDIRERVLRGLEFMGVYWDPSLNQVRGEEAFISYPHSPVKVMIIPTNEEVMIARDVERIAK

SEQ ID NO: 214 - protein, 396 aa, Bacillus sporothermodurans
MSKIIAINAGSSSLKFQLFEMPEERVISKGLIERIGLANSIFTISVNDEKYKEVMDIPNHEVAVKLLLDKLTELNIIQSLNEIEGIGHRVVHGGEIFNDSVLITEEVVEQLIKLSDLAPLHNPANIIGIQACHAALPNVPAVAVFDTAFHQTMPESSFLYSLPYDYYEKYGIRKYGFHGTSHKYVSRRAAEMLGRPIEQLRLISCHLGNGASIAAIEGGKSIDTSMGFTPLAGVAMGTRSGNIDPALIPFIMDKTGKTADEVLDVLNKKSGMLGVSGFSSDLRDIEQEAAKGNNRAELALEVFANRIHKYIGSYSARMSGVDAIIFTAGIGENSDLVRAKVLHGLEFMGIYWDPALNKIRGKEAFINYPHSPVKVLVIPTNEEVMIARDVVSLITK

SEQ ID NO: 215 - protein, 338 aa, Escherichia coli
MIIERCRELALRAPARVVFPDALDQRVLKAAQYLHQQGLATPILVANPFELRQFALSHGVAMDGLQVIDPHGNLAMREEFAHRWLARAGEKTPPDALEKLTDPLMFAAAMVSAGKADVCIAGNLSSTANVLRAGLRIIGLQPGCKTLSSIFLMLPQYSGPALGFADCSVVPQPTAAQLADIALASAETWRAITGEEPRVAMLSFSSNGSARHPCVANVQQATEIVRERAPKLVVDGELQFDAAFVPEVAAQKAPASPLQGKANVMVFPSLEAGNIGYKIAQRLGGYRAVGPLIQGLAAPMHDLSRGCSVQEIIELALVAAVPRQTEVNRESSLQTLVE

SEQ ID NO: 216 - protein, 714 aa, Escherichia coli
MSRIIMLIPTGTSVGLTSVSLGVIRAMERKGVRLSVFKPIAQPRTGGDAPDQTTTIVRANSSTTTAAEPLKMSYVEGLLSSNQKDVLMEEIVANYHANTKDAEVVLVEGLVPTRKHQFAQSLNYEIAKTLNAEIVFVMSQGTDTPEQLKERIELTRNSFGGAKNTNITGVIVNKLNAPVDEQGRTRPDLSEIFDDSSKAKVNNVDPAKLQESSPLPVLGAVPWSFDLIATRAIDMARHLNATIINEGDINTRRVKSVTFCARSIPHMLEHFRAGSLLVTSADRPDVLVAACLAAMNGVEIGALLLTGGYEMDARISKLCERAFATGLPVFMVNTNTWQTSLSLQSFNLEVPVDDHERIEKVQEYVANYINADWIDSLTATSERSRRLSPPAFRYQLTELARKAGKRIVLPEGDEPRTVKAAAICAERGIATCVLLGNPAEINRVAASQGVELGAGIEIVDPEVVRESYVGRLVELRKNKGMTETVAREQLEDNVVLGTLMLEQDEVDGLVSGAVHTTANTIRPPLQLIKTAPGSSLVSSVFFMLLPEQVYVYGDCAINPDPTAEQLAEIAIQSADSAAAFGIEPRVAMLSYSTGTSGAGSDVEKVREATRLAQEKRPDLMIDGPLQYDAAVMADVAKSKAPNSPVAGRATVFIFPDLNTGNTTYKAVQRSADLISIGPMLQGMRKPVNDLSRGALVDDIVYTIALTAIQSAQQQ

SEQ ID NO: 217 - protein, 323 aa, Bacillus thuringiensis
MSNLFTTVKEKVQGKGISIVLPEGTDERILGAAERLAKEELVKPILVGNREEISAKAASMNLTLAGVDIYDPATYEEMDAMVASFVERRKGKATEEDARKILKDENYFGTMLVYMGKAHGLVSGAAHSTADTVRPALQIIKTKPGVTKTSGVFIMVREEEKYVFADCAINIAPNSQDLAEIGIESAKTAELFGIDPRVAMLSFSTKGSAKSPETEKVVEATRIAKEMAPELTLDGEFQFDAAFVPSVAEKKAPGSTIKGDANVFVFPSLEAGNIGYKIAQRLGNFEAVGPILQGLNMPVNDLSRGCNEEEVYKLALITAAQAL

SEQ ID NO: 218 - protein, 331 aa, Bacillus clausii
MGDLFADIKRQVESHKPSIVLPEGTDERVLQAAAKLAADNVVKPIVIGDNDAILALADKLKITLEGITIYNPETYPGIDEMVDAFVARRKGKETEESARKLLQDVNYFGTMLVYMEKADGLVSGAAHSTGDTVRPALQIIKTQPGIKRTSGVFVMVKEDKKFVFGDCAINISPNEEELAEIATATADTAKLFGIEPKVAMLSFSTLGSASSQETKKVSAATKIAQESRPDLIIDGEFQFDAAFVPAVAQKKAPDSPLKGEANVFIFPSLESGNLGYKIAQRLGGYDAIGPILQGLNKPVNDLSRGCNVDDVYKLSLITGMQAITQKTGQGV

SEQ ID NO: 219 - protein, 598 aa, Escherichia coli
MFDKYRKTLVAGTVAITLGLSASRVMAAGFKPAPPAGQLGAVIVDPYGNAPLTALVDLDSHVISDVKVTVHGKGEKGVEISYPVGQESLKTYDGVPIFGLYQKFANKVTVEWKENGKVMKDDYVVHTSAIVNNYMDNRSISDLQQTKVIKVAPGFEDRLYLVNTHTFTAQGSDLHWHGEKDKNAGILDAGPATGALPFDIAPFTFIVDTEGEYRWWLDQDTFYDGRDRDINKRGYLMGIRETPRGTFTAVQGQHWYEFDMMGQVLEDHKLPRGFADATHESIETPNGTVLLRVGKSNYRRDDGVHVTTIRDHILEVDKSGRVVDVWDLTKILDPKRDALLGALDAGAVCVNVDLAHAGQQAKLEPDTPFGDALGVGPGRNWAHVNSIAYDAKDDSIILSSRHQGVVKIGRDKQVKWILAPSKGWEKPLASKLLKPVDANGKPITCNENGLCENSDFDFTYAQHTAWISSKGTLTIFDNGDGRHLEQPALPTMKYSRFVEYKIDEKKGTVQQVWEYGKERGYDFYSPITSIIEYQADRNTMFGFGGSIHLFDVGQPTVGKLNEIDYKTKEVKVEIDVLSDKPNQTHYRALLVRPQQMFK

SEQ ID NO: 220 - protein, 354 aa, Ovis aries
AKPAAENLSLVVHGPGDLRLENYPIPEPGPNEVLLKMHSVGICGSDVHYWQGRIGDFVVKKPMVLGHEASGTVVKVGSLVRHLQPGDRVAIQPGAPRQTDEFCKIGRYNLSPTIFFCATPPDDGNLCRFYKHNANFCYKLPDNVTFEEGALIEPLSVGIHACRRAGVTLGNKVLVCGAGPIGLVNLLAAKAMGAAQVVVTDLSASRLSKAKEVGADFILEISNESPEEIAKKVEGLLGSKPEVTIECTGVETSIQAGIYATHSGGTLVLVGLGSEMTSVPLVHAATREVDIKGVFRYCNTWPMAISMLASKSVNVKPLVTHRFPLEKALEAFETSKKGLGLKVMIKCDPSDQNP

SEQ ID NO: 221 - protein, 496 aa, Bos taurus
ADREDDPNFFKMVEGFFDRGASIVEDKLVEDLKTRQTQEQKRNRVRGILRGIKPCNHVLSLSFPIRRDDGSWEVIEGYRAQHSHQRTPCKGGIRYSTDVSVDEVKALASLMTYKCAVVDVPFGGAKAGVKINPKNYYDEDLEKITRRFTMELAKKGFIGPGVDVPNMSTGEREMSWIADTASTIGHYDINAHACVTKPGISQGGIHGRISATGRGVFGHIENFIENASYMSILGMTPGFGDKTFAVQGFGNVGLHSMRYLHRFGAKCVAVGESDGSIWNPDGIDPKELEDFKLQHGTILGFPKAKIYEGSILEVDCDILIPAASEKQLTKSNAPRVKAKIIAEGANGPTTPQADKIFLERNIMVIPDLYLNAGGVTVSYFGLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFRVYNEAGVTF

SEQ ID NO: 222 - protein, 452 aa, Candida utilis
SNLPSEPEFEQAYKELAYTLENSSLFQKHPEYRTALTVASIPERVIQFRVVWEDDDGNVQVNRGYRVQFNSALGPYKGGLRLHPSVNLSILKFLGFEQIFKNALTGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVENINAVMAIKEARQSLTSFQHAGHLKWIEGARPWLHVGKVDIALPCATEDEVSKEEAEGLLAAGCKFVAEGSNMGCTLEAIEVFENNRKEKKGEAVWYAPGKAANCGGVAVSGLEMAQNSQRLNWTQAEVDEKLKDIMKNAFFNGLNTAKTYVEAAEGQLPSLVAGSNIAGFVKVAQAMHDQGDWSKN

SEQ ID NO: 223 - protein, 348 aa, Saccharomyces cerevisiae
MSIPETQKGVIFYESHGKLEYKDIPVPKPKANELLINVKYSGVCHTDLHAWHGDWPLPVKLPLVGGHEGAGVVVGMGENVKGWKIGDYAGIKWLNGSCMACEYCELGNESNCPHADLSGYTHDGSFQQYATADAVQAAHIPQGTDLAQVAPILCAGITVYKALKSANLMAGHWVAISGAAGGLGSLAVQYAKAMGYRVLGIDGGEGKEELFRSIGGEVFIDFTKEKDIVGAVLKATDGGAHGVINVSVSEAAIEASTRYVRANGTTVLVGMPAGAKCCSDVFNQVVKSISIVGSYVGNRADTREALDFFARGLVKSPIKVVGLSTLPEIYEKMEKGQIVGRYVVDTSK

SEQ ID NO: 224 - protein, 333 aa, Sus scrofa
MSEPIRVLVTGAAGQIAYSLLYSIGNGSVFGKDQPIILVLLDITPMMGVLDGVLMELQDCALPLLKDVIATDKEEIAFKDLDVAILVGSMPRRDGMERKDLLKANVKIFKCQGAALDKYAKKSVKVIVVGNPANTNCLTASKSAPSIPKENFSCLTRLDHNRAKAQIALKLGVTSDVKNVIIWGNHSSTQYPDVNHAKVKLQAKEVGVYEAVKDDSWLKGEFITTVQQRGAAVIKARKLSSAMSAAKAICDHVRDIWFGTPEGEFVSMGIISDGNSYGVPDDLLYSFPVTIKDKTWKIVEGLPINDFSREKMDLTAKELAEEKETAFEFLSSA

SEQ ID NO: 225 - DNA, 1497 bp, Bacillus cereus
atggaattaaaaaaatttattgatccccttccgattcccactgcaataaaacctacaggaacatataagggtaaaccattttatgatgtacgtatgattgaaacgctacacaagtttcatattgatttaccaaagacgaaagtatggggttataatggaatggtacctggtccaacgtttgaggtgaaaaaagatcatcctgtatatgtgagatggtcaaacgatttacctaaaaaacacttcttacctgttgatacaaccgttcatggggcgcatgataacccagaagtacgaactgttgtacatttacatggaagcccaagtgaaccagatagcgatggtcatcctgaagcatggtttacgaaaaactttcaacaaacaggacctagtttcgtaaaagagatttatcattattcgaatcgagaacgagcaactgccctttggtatcatgatcatgcacttgggattactcgtttaaatttatatgcgggtctcgcaggactttacttgattcgtgataaagaagaaaaatcactacccctacctaaagggaaatacgagataccacttatcgttcaagataaatcttttaatccggacggttccctattttatcctgctcaacctgaagatccatcaccaggtttaccatacccttctattgttcctctatttttaggaaatacaattgcagtcaacgggaaagtatggccatttttaaaagtggagccccgcaaatatagatttcgtttattaaacgcttctaatactcgcacatacaagttccaattaagtgaccttagctcattctttttaatagggactgatggaggccttcttaaacggccgattaaagtacaaagtttagatgtttcatcagcagagcgtattgacattattattgatttttcaaggtttgaagggaaaaaagtagttttacaaaatggaattgatttagataatccaactggtgagataatggagttccaagtaacgaaaagattaccctgcccagataaaagtaaaatcccatgcaaattaagtaacattgactttattcccgtagaaaaagtaaagaaagtaagacgattaacattaaatgactcagaggatgaatttggacgtctcatgcttttattagataataaagaatgggacgatccagtgacagaaacacctttattaaattctgttgaaatatgggagttagtaaatttgaccgttgggattcatcctattcatatacatctagttaattttcaagttcttgatcgtcatgatttaaatggaaacttattaaatcctctcccagctgatttcggattaaaagataccgttctagtagcaggtgaacaaaccgtccgaatcataatgaagtttgagccctattctggagattatgtatggcactgtcatcgtttagagcatgaagaccatgatatgatgagaccgttaaaaatcataccttccaatcttaatagacacaaattaaattga

SEQ ID NO: 226 - DNA, 1656 bp, Bacillus cereus
atgtctttagagaagtttgtagatgcattacctattccacctgtcttaaaagcgaaagataggtgtgataacattccgttctatgaggtaactatgaagcaagtcgaacagaagttacatcgtgatttgccgccaactaccgtttggggttacaacggtatgtaccctggtcctacattcgaagcacgaagaaatcaccctattttagtcaaatggaaaaatgaattaccttttgaacatctgctacccgtagatcgaactattcatggcgcagaaccagacaaaccttctgttaggacagttgtacatttgcatgaaggtcgggttagaccggaaaatgacggatatccagaagcatggtttacacgaaactttgaaaatgttggcccgaaattcgtgcatgaagtttactattatccaaactgtcaacgacctgcgactctatggtatcatgaccatgcccttggaatcactcgtttgaacgtttatgcaggacttgcagggttctatctccttcgagataagaaagaggaagaattgaacttaccaaatggaaagtttgaaattccactagtcatacaagatcgttcattttatcctaatggtgaactgttctatccaactcaaccaggacatgagccacctccagcgccacaaccacctccaccaatagatccaacattaccaaatccatcagttgtaccagaattttttggaaacaccatcctagtcaatggaaaagtatggccttatcttgtagtcgagccacggaaataccggttccgcatccttaatggctctaacgctcgtttttatcgtataaagttgagttctggacaaaattttgtccaaattggcacagaaggaggacttttggaaaaaccaatcatcgtatccgaaatcatccttgcaccagctgaacgtgtcgatgttattatcgatttttcaaaccataaaggtcaaagtattatcttaacaaatgacgcaccagctccattccctaacggtgcccaaccttcttcagacctgacacaaattatggaattttgtgtcaaacaaaaattgcacaaacctgacaacagtaaaattccaaaaaagttaagttgcttagaacacttggatcctaatgatgctgtaatcgtacgaaaaaacctcttagttgaaactaccgatgaattcgggcgtttaaaacttttattaaataacctagattggaatcaaatgccccttacagaaaccccatataatgggacgatagagatttgggagctttacaatactacaccggacactcaccctattcatttgcaccttgttacttttcaaattttgaatcgtgctacgtttactggtgatccaaatggtcctgaccttatagttggaccgccacaaccacccgatccaagcgagatgggttggaaagataccgttcgtgccaatcctggggaggtcacccgtatcattgcgcgttttgggccatttataggaatctacccgtggcactgccacatccttgaacacgaagaccatgatatgatgagaccatacgaagttctcgataatcaaaactttaacccgtgtgaaccgatccctggggaatgtccagatgattcgttcactcagtgtttcgatcgtgataatgatgacgatgattga

SEQ ID NO: 227 - DNA, 537 bp, Bacillus thuringiensis
atgaaactagtcgttattaacggtacaccaagaaaatttggcagaactcgcgtggtggcaaaatatattgcggatcaatttgaaggggaattatatgatttagcaatcgaggagttacctttatacaatggagaagagtcacaacgtgatttagaggcagtaaaaaaattgaaaacgttagtgaaagctgcggatggggttgtattatgtacaccagaatatcataatgcgatgagcggtgcgctgaaaaactctttagattacttaagtagtagtgaatttattcataaaccagttgcgttgttagcggttgctggtggcggtaaaggtggaataaatgcattaaacagcatgcgaacggtcgctagaggtgtttatgcaaatgcaattccaaaacaagttgtgcttgatggattacatgtgcaagatggggaacttggggaagatgcgaaaccattaattcatgatgtagttaaagagttaaaagcatatatgagcgtatataaagaggtgaaaaagcaactaggagtggagtga

SEQ ID NO: 228 - protein, 498 aa, Bacillus cereus
MELKKFIDPLPIPTAIKPTGTYKGKPFYDVRMIETLHKFHIDLPKTKVWGYNGMVPGPTFEVKKDHPVYVRWSNDLPKKHFLPVDTTVHGAHDNPEVRTVVHLHGSPSEPDSDGHPEAWFTKNFQQTGPSFVKEIYHYSNRERATALWYHDHALGITRLNLYAGLAGLYLIRDKEEKSLPLPKGKYEIPLIVQDKSFNPDGSLFYPAQPEDPSPGLPYPSIVPLFLGNTIAVNGKVWPFLKVEPRKYRFRLLNASNTRTYKFQLSDLSSFFLIGTDGGLLKRPIKVQSLDVSSAERIDIIIDFSRFEGKKVVLQNGIDLDNPTGEIMEFQVTKRLPCPDKSKIPCKLSNIDFIPVEKVKKVRRLTLNDSEDEFGRLMLLLDNKEWDDPVTETPLLNSVEIWELVNLTVGIHPIHIHLVNFQVLDRHDLNGNLLNPLPADFGLKDTVLVAGEQTVRIIMKFEPYSGDYVWHCHRLEHEDHDMMRPLKIIPSNLNRHKLN

SEQ ID NO: 229 - protein, 551 aa, Bacillus cereus
MSLEKFVDALPIPPVLKAKDRCDNIPFYEVTMKQVEQKLHRDLPPTTVWGYNGMYPGPTFEARRNHPILVKWKNELPFEHLLPVDRTIHGAEPDKPSVRTVVHLHEGRVRPENDGYPEAWFTRNFENVGPKFVHEVYYYPNCQRPATLWYHDHALGITRLNVYAGLAGFYLLRDKKEEELNLPNGKFEIPLVIQDRSFYPNGELFYPTQPGHEPPPAPQPPPPIDPTLPNPSVVPEFFGNTILVNGKVWPYLVVEPRKYRFRILNGSNARFYRIKLSSGQNFVQIGTEGGLLEKPIIVSEIILAPAERVDVIIDFSNHKGQSIILTNDAPAPFPNGAQPSSDLTQIMEFCVKQKLHKPDNSKIPKKLSCLEHLDPNDAVIVRKNLLVETTDEFGRLKLLLNNLDWNQMPLTETPYNGTIEIWELYNTTPDTHPIHLHLVTFQILNRATFTGDPNGPDLIVGPPQPPDPSEMGWKDTVRANPGEVTRIIARFGPFIGIYPWHCHILEHEDHDMMRPYEVLDNQNFNPCEPIPGECPDDSFTQCFDRDNDDDD

SEQ ID NO: 230 - protein, 178 aa, Bacillus thuringiensis
MKLVVINGTPRKFGRTRVVAKYIADQFEGELYDLAIEELPLYNGEESQRDLEAVKKLKTLVKAADGVVLCTPEYHNAMSGALKNSLDYLSSSEFIHKPVALLAVAGGGKGGINALNSMRTVARGVYANAIPKQVVLDGLHVQDGELGEDAKPLIHDVVKELKAYMSVYKEVKKQLGVE

SEQ ID NO: 231 - DNA, 43 bp, Bacillus cereus
gatgaaacggtcaatcatgggaaaagaaaaaaagtatgatgcc

SEQ ID NO: 232 - DNA, 41 bp, Bacillus cereus
aacagctcgagtggctgcttaatattttgtcgtcagctcag

SEQ ID NO: 233 - DNA, 37 bp, Bacillus cereus
gatgaaacggtcaatcatggcgattcgaacaggggct

SEQ ID NO: 234 - DNA, 38 bp, Bacillus cereus
aacagctcgagtggctgctcaccttaatgaatttccag

SEQ ID NO: 235 - DNA, 46 bp, Bacillus cereus
gatgaaacggtcaatcgtgcctttagattattcaaaaattttaaag

SEQ ID NO: 236 - DNA, 39 bp, Bacillus cereus
aacagctcgagtggctgcctattctggtttctgttctgg

SEQ ID NO: 237 - DNA, 42 bp, Bacillus mycoides
gatgaaacggtcaatcatgaaagaacttaaccaatttttagg

SEQ ID NO: 238 - DNA, 48 bp, Bacillus mycoides
aacagctcgagtggctgcttaaaaagttaattttcctgaacggatatc

SEQ ID NO: 239 - DNA, 37 bp, Unknown
  Bradyrhizobiaceae  family
gatgaaacggtcaatcatgagcctgatcgcaattaag

SEQ ID NO: 240 - DNA, 36 bp, Unknown
  Bradyrhizobiaceae family
aacagctcgagtggctgctcaatggacgggccaccg

SEQ ID NO: 241 - DNA, 40 bp, Pseudomonas sp.
ggtggacagcaaatgggtcgcatgccgcctggatgttccg

SEQ ID NO: 242 - DNA, 41 bp, Pseudomonas sp.
tggtggtggtggtgctcgagtcaaggcctggctgcgagatc

SEQ ID NO: 243 - DNA, 1227 bp, Bacillus cereus
atgggaaaagaaaaaaagtatgatgccatagtagttggggcgggaccagtcgggcttgtagcaggacttgcattacaaaagaaggggatatcaactttagtaattgaggcagattcattcggaagaccacgcccgggaagtagagcaatctatttgcatagtgcttcgttaaaactactggaagagacttcagaaggtctcggtttcacgcttgcacataacggaataatttggcctgtaaaacgaacattttataaagggaaagaagtatatgtaagagattacggtaaggatgaaaaccttaagtttaaccgattacctcatttcacagctcttcatcaagatgaaattgaaaaacatatgtatgaggcgtgtataaaagaaggtgttgaattcctttgggatgccccggtcaagaagttacacattacagattctggagtagaactaacaatcacaaatgacgaaatcttaaaggcgcagtatgtaattggatgtgatggagcacgttccatcgtaagagaagaagctggattaacgtttgaaggcccacgtacagcagatacttttatcgtcgtagatgcaaaagaagatgaaacagatccacttcctttagaaagaatattccattatcagcatccagctatggaaggaagaaatgtaatgtttgttccgtttaaaggcgggtggcgtatcgatttacaactgcttgaatcagataatccagacgattatacaaatattgaaagtgtaaagacatggttgccgaaagtcatggatgctaagtacgcagagaggattacttgggtgtcctcctatcgtttccatcaagtagtggcaaattcatttactgacgaaaaacgtcgtgttcttctagctggagaagcagcacacttatttgccccattcggagcacgtggattaaattctggtattccagatgctgttcttgctgcaagaggcattgagaaagcactacattctcattctgaagaagaacgagtagaagcaattgaagcagctgcaaaagaacgccgaattgcagcgcagtggaaccgcgatgcatcaactacagcacttcatcatcttcaaggaagttctcctgaaatgaatatgaaacgtgacattgctgcttcactggtatctatcgttccgaggcttggaagatggcttgacgaaggaccatatggaccgaaatttggacctcctgagctgacgacaaaatat

SEQ ID NO: 244 - DNA, 1227 bp, Bacillus cereus
atgggaaaagaaaaaaagtatgatgccatagtagttggggcgggaccagtcgggcttgtagcaggacttgcattacaaaagaaggggatatcaactttagtaattgaggcagattcattcggaagaccacgcccgggaagtagagcaatctatttgcatagtgcttcgttaaaactactggaagagacttcagaaggtctcggtttcacgcttgcacataacggaataatttggcctgtaaaacgaacattatataaagggaaagaagtatatgtaagagattacggtaaggatgaaaaccttaagtttaaccgattacctcatttcacagctcttcatcaagatgaaattgaaaaacatatgtatgaggcgtgtataaaagaaggtgttgaattcctttgggatgccccggtcaagaagttacacattacagattctggagtagaactaacaatcacaaatgacgaaatcttaaaggcgcagtatgtaattggatgtgatggagcacgttccatcgtaagagaagaagctggattaacgtttgaaggcccacgtacagcagatacttttatcgtcgtagatgcaaaagaagatgaaacagatccacttcctttagaaagaatattccattatcagcatccagctatggaaggaagaaatgtaatgtttgttccgtttaaaggcgggtggcgtatcgatttacaactgcttgaatcagataatccagacgattatacaaatattgaaagtgtaaagacatggttgccgaaagtcatggatgctaagtacgcagagaggattacttgggtgtcctcctatcgtttccatcaagtagtggcaaattcatttactgacgaaaaacgtcgtgttcttctagctggagaagcagcacacttatttgccccattcggagcacgtggattaaattctggtattccagatgctgttcttgctgcaagaggcattgagaaagcactacattctcattctgaagaagaacgagtagaagcaattgaagcagctgcaaaagaacgccgaattgcagcgcagtggaaccgcgatgcatcaactacagcacttcatcatcttcaaggaagttctcctgaaatgaatatgaaacgtgacattgctgcttcactggtatctatcgttccgaggcttggaagatggcttgacgaaggaccatatggaccgaaatttggacctcctgagctgacgacaaaatat

SEQ ID NO: 245 - DNA, 1227 bp, Bacillus cereus
atgggaaaagaaaaaaagtatgatgccatagtagttggggcgggaccagtcgggcttgtagcaggacttgcattacaaaagaaggggatatcaactttagtaattgaggcagattcattcggaagaccacgcccgggaagtagagcaatctatttgcatagtgcttcgttaaaactactggaagagacttcagaaggtctcggtttcacgcttgcacataacggaataatttggcctgtaaaacgaacattttataaagggaaagaagtatatgtaagagattacggtaaggatgaaaaccttaagtttaaccgattacctcatttcacagctcttcatcaagatgaaattgaaaaacatatgtatgaggcgtgtataaaagaaggtgttgaattcctttgggatgccccggtcaagaagttacacattacagattctggagtagaactaacaatcacaaatgacgaaatcttaaaggcgcagtatgtaattggatgtgatggagcacgttccatcgtaagagaagaagctggattaacgtttgaaggcccacgtacagcagatacttttatcgtcgtagatgcaaaagaagatgaaacagatccacttcctttagaaagaatattccattatcagcatccagctatggaaggaagaaatgtaatgtttgttccgtttaaaggcgggtggcgtatcgatttacaactgcttgaatcagataatccagacgatttaacaaatattgaaagtgtaaagacatggttgccgaaagtcatggatgctaagtacgcagagaggattacttgggtgtcctcctatcgtttccatcaagtagtggcaaattcatttactgacgaaaaacgtcgtgttcttctagctggagaagcagcacacttatttgccccattcggagcacgtggattaaattctggtattccagatgctgttcttgctgcaagaggcattgagaaagcactacattctcattctgaagaagaacgagtagaagcaattgaagcagctgcaaaagaacgccgaattgcagcgcagtggaaccgcgatgcatcaactacagcacttcatcatcttcaaggaagttctcctgaaatgaatatgaaacgtgacattgctgcttcactggtatctatcgttccgaggcttggaagatggcttgacgaaggaccatatggaccgaaatttggacctcctgagctgacgacaaaatat

SEQ ID NO: 246 - DNA, 1227 bp, Bacillus cereus
atgggaaaagaaaaaaagtatgatgccatagtagttggggcgggaccagtcgggcttgtagcaggacttgcattacaaaagaaggggatatcaactttagtaattgaggcagattcattcggaagaccacgcccgggaagtagagcaatctatttgcatagtgcttcgttaaaactactggaagagacttcagaaggtctcggtttcacgcttgcacataacggaataatttggcctgtaaaacgaacattatataaagggaaagaagtatatgtaagagattacggtaaggatgaaaaccttaagtttaaccgattacctcatttcacagctcttcatcaagatgaaattgaaaaacatatgtatgaggcgtgtataaaagaaggtgttgaattcctttgggatgccccggtcaagaagttacacattacagattctggagtagaactaacaatcacaaatgacgaaatcttaaaggcgcagtatgtaattggatgtgatggagcacgttccatcgtaagagaagaagctggattaacgtttgaaggcccacgtacagcagatacttttatcgtcgtagatgcaaaagaagatgaaacagatccacttcctttagaaagaatattccattatcagcatccagctatggaaggaagaaatgtaatgtttgttccgtttaaaggcgggtggcgtatcgatttacaactgcttgaatcagataatccagacgatttaacaaatattgaaagtgtaaagacatggttgccgaaagtcatggatgctaagtacgcagagaggattacttgggtgtcctcctatcgtttccatcaagtagtggcaaattcatttactgacgaaaaacgtcgtgttcttctagctggagaagcagcacacttatttgccccattcggagcacgtggattaaattctggtattccagatgctgttcttgctgcaagaggcattgagaaagcactacattctcattctgaagaagaacgagtagaagcaattgaagcagctgcaaaagaacgccgaattgcagcgcagtggaaccgcgatgcatcaactacagcacttcatcatcttcaaggaagttctcctgaaatgaatatgaaacgtgacattgctgcttcactggtatctatcgttccgaggcttggaagatggcttgacgaaggaccatatggaccgaaatttggacctcctgagctgacgacaaaatat

SEQ ID NO: 247 - DNA, 1227 bp, Bacillus cereus
atgggaaaagaaaaaaagtatgatgccatagtagttggggcgggaccagtcgggcttgtagcaggacttgcattacaaaagaaggggatatcaactttagtaattgaggcagattcattcggaagaccacgcccgggaagtagagcaatctatttgcatagtgcttcgttaaaactactggaagagacttcagaaggtctcggtttcacgcttgcacataacggaataatttggcctgtaaaacgaacaatttataaagggaaagaagtatatgtaagagattacggtaaggatgaaaaccttaagtttaaccgattacctcatttcacagctcttcatcaagatgaaattgaaaaacatatgtatgaggcgtgtataaaagaaggtgttgaattcctttgggatgccccggtcaagaagttacacattacagattctggagtagaactaacaatcacaaatgacgaaatcttaaaggcgcagtatgtaattggatgtgatggagcacgttccatcgtaagagaagaagctggattaacgtttgaaggcccacgtacagcagatacttttatcgtcgtagatgcaaaagaagatgaaacagatccacttcctttagaaagaatattccattatcagcatccagctatggaaggaagaaatgtaatgtttgttccgtttaaaggcgggtggcgtatcgatttacaactgcttgaatcagataatccagacgattatacaaatattgaaagtgtaaagacatggttgccgaaagtcatggatgctaagtacgcagagaggattacttgggtgtcctcctatcgtttccatcaagtagtggcaaattcatttactgacgaaaaacgtcgtgttcttctagctggagaagcagcacacttatttgccccattcggagcacgtggattaaattctggtattccagatgctgttcttgctgcaagaggcattgagaaagcactacattctcattctgaagaagaacgagtagaagcaattgaagcagctgcaaaagaacgccgaattgcagcgcagtggaaccgcgatgcatcaactacagcacttcatcatcttcaaggaagttctcctgaaatgaatatgaaacgtgacattgctgcttcactggtatctatcgttccgaggcttggaagatggcttgacgaaggaccatatggaccgaaatttggacctcctgagctgacgacaaaatat

SEQ ID NO: 248 - DNA, 1227 bp, Bacillus cereus
atgggaaaagaaaaaaagtatgatgccatagtagttggggcgggaccagtcgggcttgtagcaggacttgcattacaaaagaaggggatatcaactttagtaattgaggcagattcattcggaagaccacgcccgggaagtagagcaatctatttgcatagtgcttcgttaaaactactggaagagacttcagaaggtctcggtttcacgcttgcacataacggaataatttggcctgtaaaacgaacattttataaagggaaagaagtatatgtaagagattacggtaaggatgaaaaccttaagtttaaccgattacctcatttcacagctcttcatcaagatgaaattgaaaaacatatgtatgaggcgtgtataaaagaaggtgttgaattcctttgggatgccccggtcaagaagttacacattacagattctggagtagaactaacaatcacaaatgacgaaatcttaaaggcgcagtatgtaattggatgtgatggagcacgttccatcgtaagagaagaagctggattaacgtttgaaggcccacgtacagcagatacttttatcgtcgtagatgcaaaagaagatgaaacagatccacttcctttagaaagaatattccattatcagcatccagctatggaaggaagaaatgtaatgtttgttccgtttaaaggcgggtggcgtatcgatttacaactgcttgaatcagataatccagacgatattacaaatattgaaagtgtaaagacatggttgccgaaagtcatggatgctaagtacgcagagaggattacttgggtgtcctcctatcgtttccatcaagtagtggcaaattcatttactgacgaaaaacgtcgtgttcttctagctggagaagcagcacacttatttgccccattcggagcacgtggattaaattctggtattccagatgctgttcttgctgcaagaggcattgagaaagcactacattctcattctgaagaagaacgagtagaagcaattgaagcagctgcaaaagaacgccgaattgcagcgcagtggaaccgcgatgcatcaactacagcacttcatcatcttcaaggaagttctcctgaaatgaatatgaaacgtgacattgctgcttcactggtatctatcgttccgaggcttggaagatggcttgacgaaggaccatatggaccgaaatttggacctcctgagctgacgacaaaatat

SEQ ID NO: 249 - DNA, 1227 bp, Bacillus cereus
atgggaaaagaaaaaaagtatgatgccatagtagttggggcgggaccagtcgggcttgtagcaggacttgcattacaaaagaaggggatatcaactttagtaattgaggcagattcattcggaagaccacgcccgggaagtagagcaatctatttgcatagtgcttcgttaaaactactggaagagacttcagaaggtctcggtttcacgcttgcacataacggaataatttggcctgtaaaacgaacaatttataaagggaaagaagtatatgtaagagattacggtaaggatgaaaaccttaagtttaaccgattacctcatttcacagctcttcatcaagatgaaattgaaaaacatatgtatgaggcgtgtataaaagaaggtgttgaattcctttgggatgccccggtcaagaagttacacattacagattctggagtagaactaacaatcacaaatgacgaaatcttaaaggcgcagtatgtaattggatgtgatggagcacgttccatcgtaagagaagaagctggattaacgtttgaaggcccacgtacagcagatacttttatcgtcgtagatgcaaaagaagatgaaacagatccacttcctttagaaagaatattccattatcagcatccagctatggaaggaagaaatgtaatgtttgttccgtttaaaggcgggtggcgtatcgatttacaactgcttgaatcagataatccagacgatattacaaatattgaaagtgtaaagacatggttgccgaaagtcatggatgctaagtacgcagagaggattacttgggtgtcctcctatcgtttccatcaagtagtggcaaattcatttactgacgaaaaacgtcgtgttcttctagctggagaagcagcacacttatttgccccattcggagcacgtggattaaattctggtattccagatgctgttcttgctgcaagaggcattgagaaagcactacattctcattctgaagaagaacgagtagaagcaattgaagcagctgcaaaagaacgccgaattgcagcgcagtggaaccgcgatgcatcaactacagcacttcatcatcttcaaggaagttctcctgaaatgaatatgaaacgtgacattgctgcttcactggtatctatcgttccgaggcttggaagatggcttgacgaaggaccatatggaccgaaatttggacctcctgagctgacgacaaaatat

SEQ ID NO: 250 - DNA, 1263 bp, Pseudommas putida
atgagcaaaagcccgctgcgcgtggcggtgattggcggcggcattgcgggcaccgcgctggcgctgggcctgagcaaaagcagccatgtgaacgtgaaactgtttgaaaccgcgccggcgtttggcgaaattggcgcgggcgtgagctttggcgtgaacgcggtggaagcgattcagcgcctgggcattggcgaactgtataaaagcgtggcggatagcaccccggcgccgtggcaggatatttggtttgaatggcgccatgcgcatgatgcgagcctggtgggcgcgaccgtggcgccgggcattggccagagcagcattcatcgcgcggattttattgatatgctggaaaaacgcctgccggcgggcattgcgagcctgggcaaacatgtggtggattataccgaaaacgcggaaggcgtgaccctgaactttgcggatggcagcacctataccgcggatgtggcgattgcggcggatggcattaaaagcagcatgcgcaacaccctgctgcgcgcggcgggccatgatgcggtgcatccgcagtttaccggcaccagcgcgtatcgcggcctggtggaaaccagcgcgctgcgcgaagcgtatcaggcggcgagcctggatgaacatctgctgaacgtgccgcagatgtatctgattgaagatggccatgtgctgacctttccggtgaaaaaaggcaaactgattattattgtggcgtttgtgagcgatcgcagcgtggcgaaaccgcagtggccgagcgatcagccgtgggtgcgcccggcgaccaccgatgaaatgctgcatcgctttgcgggcgcgggcgaagcggtgaaaaccctgctgaccagcattaaaagcccgaccctgtgggcgctgcatgattttgatccgctgccgacctatgtgcatggccgcgtggcgctgattggcgatgcggcgcatgcgatgctgccgcatcagggcgcgggcgcgggccagggcctggaagatgcgtattttatggcggaactgctgggcaacccgctgcatgaagcgagcgatattccggcgctgctggaagtgtatgatgatgtgcgccgcggccgcgcgagcaaagtgcagctgaccagccgcgaagcgggcgaactgtatgaatatcgcaccccgggcgtggaacgcgataccgcgaaactgaaagcgctgctggaaagccgcatgaactggatttggaactatgatctgggcgcggaagcgcgcctggcggtgaaaccggcgctggcg

SEQ ID NO: 251 - protein, 409 aa, Bacillus cereus
MGKEKKYDAIVVGAGPVGLVAGLALQKKGISTLVIEADSFGRPRPGSRAIYLHSASLKLLEETSEGLGFTLAHNGIIWPVKRTFYKGKEVYVRDYGKDENLKFNRLPHFTALHQDEIEKHMYEACIKEGVEFLWDAPVKKLHITDSGVELTITNDEILKAQYVIGCDGARSIVREEAGLTFEGPRTADTFIVVDAKEDETDPLPLERIFHYQHPAMEGRNVMFVPFKGGWRIDLQLLESDNPDDYTNIESVKTWLPKVMDAKYAERITWVSSYRFHQVVANSFTDEKRRVLLAGEAAHLFAPFGARGLNSGIPDAVLAARGIEKALHSHSEEERVEAIEAAAKERRIAAQWNRDASTTALHHLQGSSPEMNMKRDIAASLVSIVPRLGRWLDEGPYGPKFGPPELTTKY

SEQ ID NO: 252 - protein, 409 aa, Bacillus cereus
MGKEKKYDAIVVGAGPVGLVAGLALQKKGISTLVIEADSFGRPRPGSRAIYLHSASLKLLEETSEGLGFTLAHNGIIWPVKRTLYKGKEVYVRDYGKDENLKFNRLPHFTALHQDEIEKHMYEACIKEGVEFLWDAPVKKLHITDSGVELTITNDEILKAQYVIGCDGARSIVREEAGLTFEGPRTADTFIVVDAKEDETDPLPLERIFHYQHPAMEGRNVMFVPFKGGWRIDLQLLESDNPDDYTNIESVKTWLPKVMDAKYAERITWVSSYRFHQVVANSFTDEKRRVLLAGEAAHLFAPFGARGLNSGIPDAVLAARGIEKALHSHSEEERVEAIEAAAKERRIAAQWNRDASTTALHHLQGSSPEMNMKRDIAASLVSIVPRLGRWLDEGPYGPKFGPPELTTKY

SEQ ID NO: 253 - protein, 409 aa, Bacillus cereus
MGKEKKYDAIVVGAGPVGLVAGLALQKKGISTLVIEADSFGRPRPGSRAIYLHSASLKLLEETSEGLGFTLAHNGIIWPVKRTFYKGKEVYVRDYGKDENLKFNRLPHFTALHQDEIEKHMYEACIKEGVEFLWDAPVKKLHITDSGVELTITNDEILKAQYVIGCDGARSIVREEAGLTFEGPRTADTFIVVDAKEDETDPLPLERIFHYQHPAMEGRNVMFVPFKGGWRIDLQLLESDNPDDLTNIESVKTWLPKVMDAKYAERITWVSSYRFHQVVANSFTDEKRRVLLAGEAAHLFAPFGARGLNSGIPDAVLAARGIEKALHSHSEEERVEAIEAAAKERRIAAQWNRDASTTALHHLQGSSPEMNMKRDIAASLVSIVPRLGRWLDEGPYGPKFGPPELTTKY

SEQ ID NO: 254 - protein, 409 aa, Bacillus cereus
MGKEKKYDAIVVGAGPVGLVAGLALQKKGISTLVIEADSFGRPRPGSRAIYLHSASLKLLEETSEGLGFTLAHNGIIWPVKRTLYKGKEVYVRDYGKDENLKFNRLPHFTALHQDEIEKHMYEACIKEGVEFLWDAPVKKLHITDSGVELTITNDEILKAQYVIGCDGARSIVREEAGLTFEGPRTADTFIVVDAKEDETDPLPLERIFHYQHPAMEGRNVMFVPFKGGWRIDLQLLESDNPDDLTNIESVKTWLPKVMDAKYAERITWVSSYRFHQVVANSFTDEKRRVLLAGEAAHLFAPFGARGLNSGIPDAVLAARGIEKALHSHSEEERVEAIEAAAKERRIAAQWNRDASTTALHHLQGSSPEMNMKRDIAASLVSIVPRLGRWLDEGPYGPKFGPPELTTKY

SEQ ID NO: 255 - protein, 409 aa, Bacillus cereus
MGKEKKYDAIVVGAGPVGLVAGLALQKKGISTLVIEADSFGRPRPGSRAIYLHSASLKLLEETSEGLGFTLAHNGIIWPVKRTIYKGKEVYVRDYGKDENLKFNRLPHFTALHQDEIEKHMYEACIKEGVEFLWDAPVKKLHITDSGVELTITNDEILKAQYVIGCDGARSIVREEAGLTFEGPRTADTFIVVDAKEDETDPLPLERIFHYQHPAMEGRNVMFVPFKGGWRIDLQLLESDNPDDYTNIESVKTWLPKVMDAKYAERITWVSSYRFHQVVANSFTDEKRRVLLAGEAAHLFAPFGARGLNSGIPDAVLAARGIEKALHSHSEEERVEAIEAAAKERRIAAQWNRDASTTALHHLQGSSPEMNMKRDIAASLVSIVPRLGRWLDEGPYGPKFGPPELTTKY

SEQ ID NO: 256 - protein, 409 aa, Bacillus cereus
MGKEKKYDAIVVGAGPVGLVAGLALQKKGISTLVIEADSFGRPRPGSRAIYLHSASLKLLEETSEGLGFTLAHNGIIWPVKRTFYKGKEVYVRDYGKDENLKFNRLPHFTALHQDEIEKHMYEACIKEGVEFLWDAPVKKLHITDSGVELTITNDEILKAQYVIGCDGARSIVREEAGLTFEGPRTADTFIVVDAKEDETDPLPLERIFHYQHPAMEGRNVMFVPFKGGWRIDLQLLESDNPDDITNIESVKTWLPKVMDAKYAERITWVSSYRFHQVVANSFTDEKRRVLLAGEAAHLFAPFGARGLNSGIPDAVLAARGIEKALHSHSEEERVEAIEAAAKERRIAAQWNRDASTTALHHLQGSSPEMNMKRDIAASLVSIVPRLGRWLDEGPYGPKFGPPELTTKY

SEQ ID NO: 257 - protein, 409 aa, Bacillus cereus
MGKEKKYDAIVVGAGPVGLVAGLALQKKGISTLVIEADSFGRPRPGSRAIYLHSASLKLLEETSEGLGFTLAHNGIIWPVKRTIYKGKEVYVRDYGKDENLKFNRLPHFTALHQDEIEKHMYEACIKEGVEFLWDAPVKKLHITDSGVELTITNDEILKAQYVIGCDGARSIVREEAGLTFEGPRTADTFIVVDAKEDETDPLPLERIFHYQHPAMEGRNVMFVPFKGGWRIDLQLLESDNPDDITNIESVKTWLPKVMDAKYAERITWVSSYRFHQVVANSFTDEKRRVLLAGEAAHLFAPFGARGLNSGIPDAVLAARGIEKALHSHSEEERVEAIEAAAKERRIAAQWNRDASTTALHHLQGSSPEMNMKRDIAASLVSIVPRLGRWLDEGPYGPKFGPPELTTKY

SEQ ID NO: 258 - protein, 421 aa, Pseudommas putida
MSKSPLRVAVIGGGIAGTALALGLSKSSHVNVKLFETAPAFGEIGAGVSFGVNAVEAIQRLGIGELYKSVADSTPAPWQDIWFEWRHAHDASLVGATVAPGIGQSSIHRADFIDMLEKRLPAGIASLGKHVVDYTENAEGVTLNFADGSTYTADVAIAADGIKSSMRNTLLRAAGHDAVHPQFTGTSAYRGLVETSALREAYQAASLDEHLLNVPQMYLIEDGHVLTFPVKKGKLIIIVAFVSDRSVAKPQWPSDQPWVRPATTDEMLHRFAGAGEAVKTLLTSIKSPTLWALHDFDPLPTYVHGRVALIGDAAHAMLPHQGAGAGQGLEDAYFMAELLGNPLHEASDIPALLEVYDDVRRGRASKVQLTSREAGELYEYRTPGVERDTAKLKALLESRMNWIWNYDLGAEARLAVKPALA

SEQ ID NO: 259 - DNA, 2028 bp, Bacillus pseudomycoides
gtgcctttagattattcaaaaattttaaagaaagtgttacttacgactactgtaactaccttaagtgttggggtagttacaggctgctcgctgttttcttcagaaaaaaagagcactaaaacagcatcagtatctaaaaagaaaaaggatagtgaaaaagaaaagaagaaagatgagaaaaaagatgaaagtaagaatgaaacaactggaaatttaaatgctaatgattttgatgaaatcattgataatgcaaaacgtagctctgatcaaaatttagctggtatcattgaaaataacaaaactaaaaagaaatttgatgatttaacggattcaattgcaaccgcagctataaattcagaccgaaacttagcatcagttattgacggtgataaatcaagtaatcgtttttcggatttaaattcttctatagcatcagcaacaaataatccttctgtctcggataataaggatagtaagaattttgtatttggtggcgatctaaatatccatgatggagtggctattgcagataactcaatacctccaattaataatgataaaaaaccaccaacttctggtgacacaggtgtcggggaagtgaaaccgccaacaggtggtgaaggtaataatggtggaagaaataaaaaaccaccaacaggcggagatggtaaagatggtggaagaggtacaaaaccaccaacaggcggagatggtaaagatggtggaggaggtacagaaccaccaacaggtggggatggtaacgatggtggtacaacaaaaccagagaaacctgaaaaagatacagtggcaccagtaattatagcaaaacaaggtgtaactgtttatgtaggagatagcttaaatgcaggagatttggtagaagttaaagataataaagatccaaacccagtagtaacagtaggagcgtacgatacaagtaaggcaggggaaattcaagtaacagtaacggcaacagatgcatcaggaaatagctcaagtacaacagtaaccgttaaagtagtagaaaaggaagaagaaaaggatacaaaagtaccagtaattacagcgaagcaaggtgtgacagtgcatgtaggagataatctaaatgcaggagacttagtagaagtaagagataataaagatccgaatccaatagtaacagtgggaacgtacgatacaagtaaggcaggggaaattcaagtaacagtaacggcaacagatgcatcaggaaatagctcaagtacaacagtaacagtaaaagtagtagaaaaagaagagggaaaagatacagaagcaccagtaattacagcaaaacaaggtgtaacagtacatgtaggagatagcttaaatgcaggagatttagtagaagtaaaagataataaagatccaaacccaatagtaacagtaggaacgcacgatacaagtaaggcaggggaaattcaagtaacagtaacggcaacagatgcatcaggaaatagctcaagtacaacagtaaccgttaaagtagtagaaaaggaagaggaaaaagatacagaagcaccagtaataacagcgaagcaaggtgtaaccgtaaatgtgggagataaattaagtccagaaagtttagtaagtgtaaaagataataaagatccaaatccagtagtaacagtgggagcgtatgatacaagtaaaccaggcacaatatcagttcaagtaacggtaacagataatgcgggtaacagttcaactgcaacggtaacagtaaaagtaatagaaaaggaagaagagaaggatacggaagcaccagtaataacagcgaagcaaggtgtaaccggacatgtgggagataaattaagtccagaaagtttagtaagtgtaaaagataataaagatccaaatccagtagtaacagtgggagcgtatgatacaagtaaaccaggcacaatatcagttcaagtaacggcaaccgataaggccggaaacagctcaactgaaacagtaaatgtggtagttcttgagaaagaaaaaccagaacagaaaccagaatag

SEQ ID NO: 260 - DNA, 1473 bp, Bacillus cereus
atggcgattcgaacaggggctcagtatattgaaggattaaaggcaagaaatcctgaaatttggattggtggaagaagaataaccgatgttgtgaatgaagatgtttttcgggaaccgattttacaaattgctaaattatatgatatgcagcacgatccagagtatcaggacaagattacccatatatgcgaagagacaggagagcgggtttcgaatgcatttttagtgccaaaaaattatgaggacttaaaagcacgccgcaaattgtttgaagtatgggcaaaagctacatttggtttaatgggtagaacaccagattttttaaatgttacagttacttcaatggcgagcaatgcatgtttttttgaaaaatttgattcctcatgggggaccaatataaaaaattattataaacatatacgtgatcaagatttgtttttaacacatgcgattatcaatccacaaaatgatcgaagtaaagcttcacatcagcaagaagatgcaacgatgcatttaggtgtagtgaacgaaacagaagagggaatgtatgtaagcggagctaagatgttagcgacacttgcaccaattacagatgaggtaatcatttattcttatccaagttttaagccgggtgatgaacgtcatgcaatttcttttgcagttcctattgatgcaccgggtttaaggatcctctgtcgcgagccaatgcaagatggaaaacgatccttgtttgatcatccacttgcatcaaggtttgaagaaatggatgcactacttgtatttcataatgtgtttattccgtgggataaagtgtttatctatcaaagtgtagaggctggaaatcagctgtatccaaaaacaggaattggtcatcaaccagcacatcaatcaggagtaagaggattagtgaaactttcttttgcagcagaagtggctataaaactagcagattcaattggagtagacggctttttaaatgtacaaaatcagttagcagaattaatccaagatgtagaaacaatccgtgcactcttgcaagtagcagaatatgagtatgaaacgaatgcatatggtgaagctgttcctgcgagattaccgctggatacaatacgtagcttattacctaaaatgtatccacgtgctattgaaattattcaaaccattggggctggtggcctactaatgttaccaacaggtgccgactttatgaatccagagattcaagaggatatgtataaatattatatcgggcgtgaaggagtatcttctgaggaacgcgttcgattatttaaattagcttgggacttatgcggtgaagcgtttggacaacgcctattacaatatgagcgttattattctggcgatccagtgagaaaaatgggtatgttttataatgcgtacaaaaaacaacaatcgctgtcacttgtggacagtgccttgcgaacagaattatctggaaattcattaaggtga

SEQ ID NO: 261 - protein, 675 aa, Bacillus pseudomycoides
VPLDYSKILKKVLLTTTVTTLSVGVVTGCSLFSSEKKSTKTASVSKKKKDSEKEKKKDEKKDESKNETTGNLNANDFDEIIDNAKRSSDQNLAGIIENNKTKKKFDDLTDSIATAAINSDRNLASVIDGDKSSNRFSDLNSSIASATNNPSVSDNKDSKNFVFGGDLNIHDGVAIADNSIPPINNDKKPPTSGDTGVGEVKPPTGGEGNNGGRNKKPPTGGDGKDGGRGTKPPTGGDGKDGGGGTEPPTGGDGNDGGTTKPEKPEKDTVAPVIIAKQGVTVYVGDSLNAGDLVEVKDNKDPNPVVTVGAYDTSKAGEIQVTVTATDASGNSSSTTVTVKVVEKEEEKDTKVPVITAKQGVTVHVGDNLNAGDLVEVRDNKDPNPIVTVGTYDTSKAGEIQVTVTATDASGNSSSTTVTVKVVEKEEGKDTEAPVITAKQGVTVHVGDSLNAGDLVEVKDNKDPNPIVTVGTHDTSKAGEIQVTVTATDASGNSSSTTVTVKVVEKEEEKDTEAPVITAKQGVTVNVGDKLSPESLVSVKDNKDPNPVVTVGAYDTSKPGTISVQVTVTDNAGNSSTATVTVKVIEKEEEKDTEAPVITAKQGVTGHVGDKLSPESLVSVKDNKDPNPVVTVGAYDTSKPGTISVQVTATDKAGNSSTETVNVVVLEKEKPEQKPE

SEQ ID NO: 262 - protein, 490 aa, Bacillus cereus
MAIRTGAQYIEGLKARNPEIWIGGRRITDVVNEDVFREPILQIAKLYDMQHDPEYQDKITHICEETGERVSNAFLVPKNYEDLKARRKLFEVWAKATFGLMGRTPDFLNVTVTSMASNACFFEKFDSSWGTNIKNYYKHIRDQDLFLTHAIINPQNDRSKASHQQEDATMHLGVVNETEEGMYVSGAKMLATLAPITDEVIIYSYPSFKPGDERHAISFAVPIDAPGLRILCREPMQDGKRSLFDHPLASRFEEMDALLVFHNVFIPWDKVFIYQSVEAGNQLYPKTGIGHQPAHQSGVRGLVKLSFAAEVAIKLADSIGVDGFLNVQNQLAELIQDVETIRALLQVAEYEYETNAYGEAVPARLPLDTIRSLLPKMYPRAIEIIQTIGAGGLLMLPTGADFMNPEIQEDMYKYYIGREGVSSEERVRLFKLAWDLCGEAFGQRLLQYERYYSGDPVRKMGMFYNAYKKQQSLSLVDSALRTELSGNSLR

SEQ ID NO: 263 - DNA, 1401 bp, Sphingomonas sp.
atggtgcggtcggttcaggacattgtcgatgacaacccggacttggtgaactatttcaaataccagaccggaggatacgcgagcgcatcgctcatcgacatccttcggcctttcattcctgccgagttcacgaattggcgcgaggagcagcgcgcttggcacgaagcggcggtgatgttcgaccagtcgcatcacatgtcagtgacctacatcaagggtccggatgccaaggcgatgctgaattatctgtcgccgtccaccttctccaatctgtccaccgatcgtggcaaacaatatttcgtcgccaatcccgacggcaagcatatcggcgactgtgtccttcattattatggggatgatgaggggttcgagctgatcagcggcaatccgctgcaaagctgggtgcggtaccattgccagacgggcgaatataacgtcgaggcgaggcacgatccaagctcacccttgggcaaagggcaccggcggacgaagtatcgctttcagcttgaaggccccaacgcccggcagatcctcgatgatgtctgcgttggaggaatgccagagctccagtttttccgcaccgcgttcgtcaccatcgcgggctgccgcgttcacatcctgcggcatggcatggccggccataccggcgcagagatctccggtccctgggacgagatggacaccgttcgtgatgcgatcctgaaggccggcgaaaagctcggcctgcgccgcggcggcacatgggcttactacagcgcgaccctggagaatggatggatcccgacgcccttccccgcgatttacaccagcgacgcaatgaaggcgtatcgcgagtggctgcccgcagccagtcttgaaggccagatgcacgtcgctggcagctattatggcgagcagatcgaggattattattgggacgcctggtcgcttggctacgacaagttcgtcaagtttgatcacgacttcatcgggcgcgcggcgctggagaagatgaagccgcagcctcatcgtgttaaacgcctcctggtgtggaacgaagacgatgtcatgaaggtgatggcgtcgcaattcggcgatgggccaatctataaagcgatcgacatgccgctggccttttatggcctgccacaggccgatgacgttcgctcgaccgacgggcgacatgtcggcgtgtcgcaatggtgcggttacacggtcaatgagcaccggatgatgtcgctttgcgggatcgacgaggcatccgccgcgccgggtaccgaagtcgttatcacctggggcgagcgcaacggcggcgcgcccaatcggcaaaccgaacgtcatgagcagacgacgatccgcgcgacggtggcgcttaccccggccgatgccctgtcgcagggccgggtccgcgcgacgctctga

SEQ ID NO: 264 - DNA, 1020 bp, Stenotrophomonas maltophilia
atggcgacctttgtgcgcaacgcgtggtatgtggcggcgctgccggaagaactgagcgaaaaaccgctgggccgcaccattctggataccccgctggcgctgtatcgccagccggatggcgtggtggcggcgctgctggatatttgcccgcatcgctttgcgccgctgagcgatggcattctggtgaacggccatatgcagtgcccgtatcatggcctggaatttgatggcggcggccagtgcgtgcataacccgcatggcaacggcgcgcgcccggcgagcctgaacgtgcgcagctttccggtggtggaacgcgatgcgctgatttggatttgcccgggcgatccggcgctggcggatccgggcgcgattccggattttggctgccgcgtggatccggcgtatcgcaccgtgggcggctatggccatgtggattgcaactataaactgctggtggataacctgatggatctgggccatgcgcagtatgtgcatcgcgcgaacgcgcagaccgatgcgtttgatcgcctggaacgcgaagtgattgtgggcgatggcgaaatccaggcgttgatgaagatccctggcggaactccgtcagttttgatggcgaagttcctgcgcggcgcgaacaccccggtggatgcgtggaacgatattcgctggaacaaagtgagcgcgatgctgaactttattgcggtggcgccggaaggcaccccgaaagaacagagcattcatagccgcggcacccatattctgaccccggaaaccgaagcgagctgccattatttttttggcagcagccgcaactttggcattgatgatccggaaatggatggcgtgctgcgcagctggcaggcgcaggcgctggtgaaagaagataaagtggtggtggaagcgattgaacgccgccgcgcgtatgtggaagcgaacggcattcgcccggcgatgctgagctgcgatgaagcggcggtgcgcgtgagccgcgaaattgaaaaactggaacagctggaagcggcg

SEQ ID NO: 265 - DNA, 1023 bp, Stenotrophomonas maltophilia
atggcgacctttgtgcgcaacgcgtggtatgtggcggcgctgccggaagaactgagcgaaaaaccgctgggccgcaccattctggataccccgctggcgctgtatcgccagccggatggcgtggtggcggcgctgctggatatttgcccgcatcgctttgcgccgctgagcgatggcattctggtgaacggccatctgcagtgcccgtatcatggcctggaatttgatggcggcggccagtgcgtgcataacccgcatggcaacggcgcgcgcccggcgagcctgaacgtgcgcagctttccggtggtggaacgcgatgcgctgatttggatttgcccgggcgatccggcgctggcggatccgggcgcgattccggattttggctgccgcgtggatccggcgtatcgcaccgtgggcggctatggccatgtggattgcaactataaactgctggtggataacctgatggatctgggccatgcgcagtatgtgcatcgcgcgaacgcgcagaccgatgcgtttgatcgcctggaacgcgaagtgattgtgggcgatggcgaaatccaggcgttgatgaagatccctggcggaactccgtcagttttgatggcgaagttcctgcgcggcgcgaacaccccggtggatgcgtggaacgatattcgctggaacaaagtgagcgcgatgctgaactttattgcggtggcgccggaaggcaccccgaaagaacagagcattcatagccgcggcacccatattctgaccccggaaaccgaagcgagctgccattatttttttggcagcagccgcaactttggcattgatgatccggaaatggatggcgtgctgcgcagctggcaggcgcaggcgctggtgaaagaagataaagtggtggtggaagcgattgaacgccgccgcgcgtatgtggaagcgaacggcattcgcccggcgatgctgagctgcgatgaagcggcggtgcgcgtgagccgcgaaattgaaaaactggaacagctggaagcggcgtaa

SEQ ID NO: 266 - DNA, 1011 bp, Sphingomonas sp.
atgacgttcgttgaagatggctggtatgtcgtggcgttgcccgaggaagtctcgttggcaccgttcgcgcgcaccattctcgatcagccgctcgtgatgttccgacaagaggacggcacacccacggtcctcctcgatatctgtcctcatcgattcgcgccgctgagcctcgggtcaatccgaaatggcgtaatacaatgcccctatcatggtctggaatttgatgctgccggcaagtgcgtgcataatccgcatggtaatggtgctagaccggcctctctgaaggtacggcattttcccacagccgagcaacacaaccttgtctgggcctggttaggggatgtcgagcgggccgatcctgcaaccataccggacttcagtttccggatcgacccgacgagggtaacgatcggcgggcatgccacggttcagtcaaactaccgactgctcgtggataacctcatggatctcagccacgcccagtttttgcatcgggccaatgtcgaaagcgatgcgttcgacaatgttcagcgctcgatccacacagtgggagacgatattatccaggagatgacgatttcaaacagcaccgtgaccaggctgcacgcgagcctgttcgagacgcctgggcagaagatcgatttcttttcggacatacgctggagcccggtcagtgccatgagcaacatgatcggcgtcgtcgctacgggtatgccgaaggatggaagtttcaactcgttcggaacgcacatcattacgcccgagaccgaaacaagctgccattatttctatgcctcttcgcgtaactacgcggtgggagatcggcaggcggacgacctgatacgcaactggcagcgtcaggcgcttatggcggaagataaacccgtcgcagaagcgatcgaggcacgaaaaggtgctgcgcgcaggaatggcatgaagccggcgatgctatcgatcgacgaagcggcagtcaaagtcagccgcgccatcgataagctggctgagcgcgtc

SEQ ID NO: 267 - DNA, 1011 bp, Sphingomonas sp.
atgacgttcgttgaagatggctggtatgtcgtggcgttgcccgaggaagtctcgttggcaccgttcgcgcgcaccattctcgatcagccgctcgtgatgttccgacaagaggacggcacacccacggtcctcctcgatatctgtcctcatcgattcgcgccgctgagcctcgggtcaatccgaaatggcgtaatacaatgcccctatcatggtctggaatttgatgctgccggcaagtgcgtgcataatccgcatggtaatggtgctagaccggcctctctgaaggtacggcattttcccacagccgagcaacacaaccttgtctgggcctggttaggggatgtcgagcgggccgatcctgcaaccataccggacttcagtttccggatcgacccgacgagggtaacgatcggcgggcatgccacggttcagtcaaactaccgactgctcgtggataacctcatggatctcagccacgcccagtttttgcatcgggccaatgtcgaaagcgatgcgttcgacaatgttcagcgctcgatccacacagtgggagacgatattatccaggagatgacgatttcaaacagcaccgtgaccaggctgcacgcgagcttcttcgagacgcctgggcagaagatcgatttctttaacgacatacgctggagcccggtcagtgccatgagcaacatgatcggcgtcgtcgctacgggtatgccgaaggatggaagtttcaactcgttcggaacgcacatcattacgcccgagaccgaaacaagctgccattatttctatgcctcttcgcgtaactacgcggtgggagatcggcaggcggacgacctgctacgcaactggcagcgtcaggcgcttatggcggaagataaagtcgtcgcagaagcgatcgaggcacgaaaaggtgctgcgcgcaggaatggcatgaagccggcgatgctatcgatcgacgaagcggcagtcaaagtcagccgcgccatcgataagctggctgagcgcgtc

SEQ ID NO: 268 - protein, 466 aa, Sphingomonas sp.
MVRSVQDIVDDNPDLVNYFKYQTGGYASASLIDILRPFIPAEFTNWREEQRAWHEAAVMFDQSHHMSVTYIKGPDAKAMLNYLSPSTFSNLSTDRGKQYFVANPDGKHIGDCVLHYYGDDEGFELISGNPLQSWVRYHCQTGEYNVEARHDPSSPLGKGHRRTKYRFQLEGPNARQILDDVCVGGMPELQFFRTAFVTIAGCRVHILRHGMAGHTGAEISGPWDEMDTVRDAILKAGEKLGLRRGGTWAYYSATLENGWIPTPFPAIYTSDAMKAYREWLPAASLEGQMHVAGSYYGEQIEDYYWDAWSLGYDKFVKFDHDFIGRAALEKMKPQPHRVKRLLVWNEDDVMKVMASQFGDGPIYKAIDMPLAFYGLPQADDVRSTDGRHVGVSQWCGYTVNEHRMMSLCGIDEASAAPGTEVVITWGERNGGAPNRQTERHEQTTIRATVALTPADALSQGRVRATL

SEQ ID NO: 269 - protein, 340 aa, Stenotrophomonas maltophilia
MATFVRNAWYVAALPEELSEKPLGRTILDTPLALYRQPDGVVAALLDICPHRFAPLSDGILVNGHMQCPYHGLEFDGGGQCVHNPHGNGARPASLNVRSFPVVERDALIWICPGDPALADPGAIPDFGCRVDPAYRTVGGYGHVDCNYKLLVDNLMDLGHAQYVHRANAQTDAFDRLEREVIVGDGEIQALMKIPGGTPSVLMAKFLRGANTPVDAWNDIRWNKVSAMLNFIAVAPEGTPKEQSIHSRGTHILTPETEASCHYFFGSSRNFGIDDPEMDGVLRSWQAQALVKEDKVVVEAIERRRAYVEANGIRPAMLSCDEAAVRVSREIEKLEQLEAA

SEQ ID NO: 270 - protein, 340 aa, Stenotrophomonas maltophilia
MATFVRNAWYVAALPEELSEKPLGRTILDTPLALYRQPDGVVAALLDICPHRFAPLSDGILVNGHLQCPYHGLEFDGGGQCVHNPHGNGARPASLNVRSFPVVERDALIWICPGDPALADPGAIPDFGCRVDPAYRTVGGYGHVDCNYKLLVDNLMDLGHAQYVHRANAQTDAFDRLEREVIVGDGEIQALMKIPGGTPSVLMAKFLRGANTPVDAWNDIRWNKVSAMLNFIAVAPEGTPKEQSIHSRGTHILTPETEASCHYFFGSSRNFGIDDPEMDGVLRSWQAQALVKEDKVVVEAIERRRAYVEANGIRPAMLSCDEAAVRVSREIEKLEQLEAA

SEQ ID NO: 271 - protein, 337 aa, Sphingomonas sp.
MTFVEDGWYVVALPEEVSLAPFARTILDQPLVMFRQEDGTPTVLLDICPHRFAPLSLGSIRNGVIQCPYHGLEFDAAGKCVHNPHGNGARPASLKVRHFPTAEQHNLVWAWLGDVERADPATIPDFSFRIDPTRVTIGGHATVQSNYRLLVDNLMDLSHAQFLHRANVESDAFDNVQRSIHTVGDDIIQEMTISNSTVTRLHASLFETPGQKIDFFSDIRWSPVSAMSNMIGVVATGMPKDGSFNSFGTHIITPETETSCHYFYASSRNYAVGDRQADDLIRNWQRQALMAEDKPVAEAIEARKGAARRNGMKPAMLSIDEAAVKVSRAIDKLAERV

SEQ ID NO: 272 - protein, 337 aa, Sphingomonas sp.
MTFVEDGWYVVALPEEVSLAPFARTILDQPLVMFRQEDGTPTVLLDICPHRFAPLSLGSIRNGVIQCPYHGLEFDAAGKCVHNPHGNGARPASLKVRHFPTAEQHNLVWAWLGDVERADPATIPDFSFRIDPTRVTIGGHATVQSNYRLLVDNLMDLSHAQFLHRANVESDAFDNVQRSIHTVGDDIIQEMTISNSTVTRLHASFFETPGQKIDFFNDIRWSPVSAMSNMIGVVATGMPKDGSFNSFGTHIITPETETSCHYFYASSRNYAVGDRQADDLLRNWQRQALMAEDKVVAEAIEARKGAARRNGMKPAMLSIDEAAVKVSRAIDKLAERV

SEQ ID NO: 273 - DNA, 864 bp, Bacillus aryabhattai
atgagcgcggtggcgaacccgctgcatccgctgtttgtgggcgaagtggaagatattgatctgcgctgcccgctgggcccggcggaagtgcgcgaaattgaacgccagatggatgaaatgagcgtgctggtgtttcgcggccaggcgctggatcaggatcagcagattgcgtttgcgcgcaactttggcccgctggaaggcggctttattaaagtgaaccagcgcccgagccgctttaaatatgcggaactggcggatattagcaacgtgagcctggatggcaaagtggcgcagcgcgatgcgcgcgaagtggtgggcaactttgcgaaccagctgtggcatagcgatagcagctttcagcagccggcggcgcgctatagcatgctgagcgcggtggtggtgccgagcagcggcggcgataccgaattttgcgatatgcgtgcggcctacgacgccttgcctgccgacctgaaagcagaactcgaagggttacaagcagaacattatgcgctgaacagccgctttctgctgggcgataccgattatagcgaagcgcagcgcaacgcgatgccgccggtgcgctggccgctggcgcgcacccatgcgggcagcggccgccgctttctgtttattggcgcgcatgcgggccatattgaaggccgcccggtggcggaaggccgcatgctgctggcggaactgctggaacatgcgacccagcgccagtttgtgtatcgccatcgctggcaggtgggcgatctggtgatgtgggataaccgctgcgtgctgcatcgcggccgccgctatgatattagcgcgcgccgcgaactgcgccgcgcgaccattctggatgatgcggtggcgtaa

SEQ ID NO: 274 - DNA, 864 bp, Bacillus aryabhattai
atgagcgcggtggcgaacccgctgcatccgctgtttgtgggcgaagtggaagatattgatctgcgctgcccgctgggcccggcggaagtgcgcgaaattgaacgccagatggatgaaatgagcgtgctggtgtttcgcggccaggcgctggatcaggatcagcagattgcgtttgcgcgcaactttggcccgctggaaggcggctttattaaagtgaaccagcgcccgagccgctttaaatatgcggaactggcggatattagcaacgtgagcctggatggcaaagtggcgcagcgcgatgcgcgcgaagtggtgggcaactttgcgaaccagctgtggcatagcgatagcagctttcagcagccggcggcgcgctatagcatgctgagcgcggtggtggtgccgagcagcggcggcgataccgaattttgcgatatgcgtgcggcctacgacgccttgcctgccgacctgaaagcagaactcgaagggttacaagcagaacattatgcgctgaacagccgctttctgctgggcgataccgattatagcgaagcgcagcgcaacgcgatgccgccggtgcgctggccgctggtgcgcacccatgcgggcagcggccgccgctttctgtttattggcgcgcatgcgggccatattgaaggccgcccggtggcggaaggccgcatgctgctggcggaactgctggaacatgcgacccagcgccagtttgtgtatcgccatcgctggcaggtgggcgatctggtgatgtgggataaccgctgcgtgctgcatcgcggccgccgctatgatattagcgcgcgccgcgaactgcgccgcgcgaccattctggatgatgcggtggcgtaa

SEQ ID NO: 275 - DNA, 861 bp, Unknown
  Burkholderiaceae family
atgagcgtggtggcgaacccgctgcatccgctgtttgcggcgggcgtggaagatattgatctgcgcgaagcgctgggcagcaccgaagtgcgcgaaattgaacgcctgatggatgaaaaaagcgtgctggtgtttcgcggccagccgctgagccaggatcagcagattgcgtttgcgcgcaactttggcccgctggaaggcggctttattaaagtgaaccagcgcccgagccgctttaaatatgcggaactggcggatattagcaacgtgagcctggatggcaaagtggcgcagcgcgatgcgcgcgaagtggtgggcaactttgcgaaccagctgtggcatagcgatagcagctttcagcagccggcggcgcgctatagcatgctgagcgcggtggtggtgccgccgagcggcggcgataccgaattttgcgatatgcgcgcggcgtatgatgcgctgccgcgcgatctgcagagcgaactggaaggcctgcgcgcggaacattatgcgctgaacagccgctttctgctgggcgataccgattatagcgaagcgcagcgcaacgcgatgccgccggtgaactggccgctggtgcgcacccatgcgggcagcggccgcaaatttctgtttattggcgcgcatgcgagccatgtggaaggcctgccggtggcggaaggccgcatgctgctggcggaactgctggaacatgcgacccagcgcgaatttgtgtatcgccatcgctggaacgtgggcgatctggtgatgtgggataaccgctgcgtgctgcatcgcggccgccgctatgatattagcgcgcgccgcgaactgcgccgcgcgaccaccctggatgatgcggtggtg

SEQ ID NO: 276 - protein, 287 aa, Bacillus aryabhattai
MSAVANPLHPLFVGEVEDIDLRCPLGPAEVREIERQMDEMSVLVFRGQALDQDQQIAFARNFGPLEGGFIKVNQRPSRFKYAELADISNVSLDGKVAQRDAREVVGNFANQLWHSDSSFQQPAARYSMLSAVVVPSSGGDTEFCDMRAAYDALPADLKAELEGLQAEHYALNSRFLLGDTDYSEAQRNAMPPVRWPLARTHAGSGRRFLFIGAHAGHIEGRPVAEGRMLLAELLEHATQRQFVYRHRWQVGDLVMWDNRCVLHRGRRYDISARRELRRATILDDAVA

SEQ ID NO: 277 - protein, 287 aa, Bacillus aryabhattai
MSAVANPLHPLFVGEVEDIDLRCPLGPAEVREIERQMDEMSVLVFRGQALDQDQQIAFARNFGPLEGGFIKVNQRPSRFKYAELADISNVSLDGKVAQRDAREVVGNFANQLWHSDSSFQQPAARYSMLSAVVVPSSGGDTEFCDMRAAYDALPADLKAELEGLQAEHYALNSRFLLGDTDYSEAQRNAMPPVRWPLVRTHAGSGRRFLFIGAHAGHIEGRPVAEGRMLLAELLEHATQRQFVYRHRWQVGDLVMWDNRCVLHRGRRYDISARRELRRATILDDAVA

SEQ ID NO: 278 - protein, 287 aa, Unknown
  Burkholderiaceae family
MSVVANPLHPLFAAGVEDIDLREALGSTEVREIERLMDEKSVLVFRGQPLSQDQQIAFARNFGPLEGGFIKVNQRPSRFKYAELADISNVSLDGKVAQRDAREVVGNFANQLWHSDSSFQQPAARYSMLSAVVVPPSGGDTEFCDMRAAYDALPRDLQSELEGLRAEHYALNSRFLLGDTDYSEAQRNAMPPVNWPLVRTHAGSGRKFLFIGAHASHVEGLPVAEGRMLLAELLEHATQREFVYRHRWNVGDLVMWDNRCVLHRGRRYDISARRELRRATTLDDAVV

SEQ ID NO: 279 - DNA, 1761 bp, Ralstonia eutropha
atgaacgaaaaagcaaacactgttgaaactgatgtattggtcgtagggacaggaccagctggtgcggctagcactttattgcttgctacctacggagttaaaacactctgtgtatctaaatatgcaactacaagccgcacaccacgtagccacattacaaaccaacgcactatggaagttatgcgtgatctaggcatcgaagcagaatgcgaggcaatggcgtctccggcagaacttatgggtgagaacgtgtactgcacaagcttggttggtgatgaattgggacgcgttcttacttggggtacgcatcctcagcgtcgtgcagactacgatttagcatctccgacacacatgtgtgatctcccacaaaacctactggaaccgattcttgtcaacaacgcggcacgtcgtggagcggatgttcgttttcacacagaatttattagtcttaatcaagatgatgcaggtgttacggcgacagtccatgaccacttgcttgatcgtcaatacgatatccgtgcaaaataccttatcggagcagatggagcgaactctcgcatcgttgatcaagtaggactgccagtagaaggtaaaatgggcgtatctggtagcatcaacgtcgtttttgaagcggacttaacaaaatatgttgggcatcgcccatctgtactttactgggtaatccaacctggcagtaacgtaggcggtcttggtatcggagttattcgtatggttcgcccatggaacaaatggttgtgcatctggggctatgatatcgctgacgggacacctgcagtcgatgaagcacacgcgcgccaaattgttcatagccttctgggagatgctacgattccggtaaaaatcgaatctactagcacttggactgtgaacgatatgtacgctacacgccttttcgacaagagagttttctgcatgggtgacgcggttcatcgccatccaccgactaacggtctgggcagcaacacgagcattcaagacgcgttcaacctctgctggaaactttctcacgtacttcgcggaaaggctggaccagaattactggctacttatgatgaagaacgtgcacccgtagcacgtcaagttgtacaacgcgctaacaaaagcttaggtgactttcctccgatccttgcggcactcggattattcgataccaaagacccggaacaaatgcagcgcaacatttctcgcctgaaagaacaatccgtcgaagcgcaagagcaacgtgcagctctacgcgctgcgatcgataacacacagtatgtttacaacgcacacggagtcgaaatgaatcagcgctacagatctgcggcgatcgtgcctgacgaaacgccggacccgggtttccgtcgagatgcagaattatatcatgaccacagctctcgaccaggcgccccactgcctcatgtatggctcacacgacacggccgccgtgtaagcacacttgatttgtgcggcaaaggtcgttttacgcttttatcaggtatcactgggagcccatggttagaagctgcgagccacgccgctgaatctctgggtatcggtctggatgtacatatcattgggcctggccaagaactggaagatctgtatggagacttcgctcgcgtacgtgaaatagaagaaagcggcgccttacttgtaagaccagacaatattatctgctggcgtgcaatgcaatgggaaaaatctgcgtcagacccacttcgtgcagctcttgcccgcgcgctttgtgcacattga

SEQ ID NO: 280 - DNA, 34 bp, Artificial Sequence
  Synthetic primer
acaaaaacatcagccatgactcacacagtacctc

SEQ ID NO: 281 - protein, 586 aa, Ralstonia eutropha
MNEKANTVETDVLVVGTGPAGAASTLLLATYGVKTLCVSKYATTSRTPRSHITNQRTMEVMRDLGIEAECEAMASPAELMGENVYCTSLVGDELGRVLTWGTHPQRRADYDLASPTHMCDLPQNLLEPILVNNAARRGADVRFHTEFISLNQDDAGVTATVHDHLLDRQYDIRAKYLIGADGANSRIVDQVGLPVEGKMGVSGSINVVFEADLTKYVGHRPSVLYWVIQPGSNVGGLGIGVIRMVRPWNKWLCIWGYDIADGTPAVDEAHARQIVHSLLGDATIPVKIESTSTWTVNDMYATRLFDKRVFCMGDAVHRHPPTNGLGSNTSIQDAFNLCWKLSHVLRGKAGPELLATYDEERAPVARQVVQRANKSLGDFPPILAALGLFDTKDPEQMQRNISRLKEQSVEAQEQRAALRAAIDNTQYVYNAHGVEMNQRYRSAAIVPDETPDPGFRRDAELYHDHSSRPGAPLPHVWLTRHGRRVSTLDLCGKGRFTLLSGITGSPWLEAASHAAESLGIGLDVHIIGPGQELEDLYGDFARVREIEESGALLVRPDNIICWRAMQWEKSASDPLRAALARALCAH

SEQ ID NO: 282 - DNA, 37 bp, Artificial Sequence
  Synthetic primer
cgactctagaggatctcagcgatttggatacaccatc

SEQ ID NO: 283 - DNA, 909 bp, Bacillus subtilis
atgaaaacagaaggattgcaccatgtcacagcattcgccagagatccgcaagaaaacttgcgattttatacagaagtgcttgggctcaggctcgttaaaaaaacagtaaactttgatgatcccggaacgtatcatttttactttgggaatcaaaacggagatcccggtacaataatgaccttttttccgttccaaggaagcggacagggaacggtaggaaaaggccaagcgggccgggtgtacttttcagttccctcaggctccctgtctttttggaaggaacgtcttgagaaaagcgggctgagcctagaggaaaaaacgttgtttggtgaaaaaggtcttatttttgatgatacagaagaccttccgctggcgatcatggaggatgcgaaaagcggcaaaagcgagtggacgcctgacgggatcacaacaaatgaagcaattacgggaatgaaaggtgtgctgctatattcctacgacccgcaggcgaccatacaattgttaacggaaagctttggatacaccaaagtggccgaagaagaccagattgtcagactggcatcttcagcggcggtcggcggtgtcattgatgtccatttacatcctgaaaaaagaggagtcggaggatatggtacggtacaccatgtagcgtttcggactaagaaaaaggaacaggcgaaatggctgccgattattgctgaaaaccatctgccttcgtcagaaattctcgacagggaatactttacatcagtttattttagggagaaaggcggtatcttatttgaaattgccacagatgaaccgggctttatgacagatgaaacgtttgctgagctagggacttccttaaaactgcctgaatggctggagaaacatagacaacaaattacagacattttacctgaactt

SEQ ID NO: 284 - protein, 303 aa, Bacillus subtilis
MKTEGLHHVTAFARDPQENLRFYTEVLGLRLVKKTVNFDDPGTYHFYFGNQNGDPGTIMTFFPFQGSGQGTVGKGQAGRVYFSVPSGSLSFWKERLEKSGLSLEEKTLFGEKGLIFDDTEDLPLAIMEDAKSGKSEWTPDGITTNEAITGMKGVLLYSYDPQATIQLLTESFGYTKVAEEDQIVRLASSAAVGGVIDVHLHPEKRGVGGYGTVHHVAFRTKKKEQAKWLPIIAENHLPSSEILDREYFTSVYFREKGGILFEIATDEPGFMTDETFAELGTSLKLPEWLEKHRQQITDILPEL

SEQ ID NO: 285 - DNA, 20 bp, Artificial Sequence
  Synthetic primer
ggctgatgtttttgtaatcg

SEQ ID NO: 286 - DNA, 19 bp, Artificial Sequence
  Synthetic primer
gatcctctagagtcgacgt

SEQ ID NO: 287 - protein, 321 aa, Bacillus subtilis
MMNKHVNKVALIGAGFVGSSYAFALINQGITDELVVIDVNKEKAMGDVMDLNHGKAFAPQPVKTSYGTYEDCKDADIVCICAGANQKPGETRLELVEKNLKIFKGIVSEVMASGFDGIFLVATNPVDILTYATWKFSGLPKERVIGSGTTLDSARFRFMLSEYFGAAPQNVHAHIIGEHGDTELPVWSHANVGGVPVSELVEKNDAYKQEELDQIVDDVKNAAYHIIEKKGATYYGVAMSLARITKAILHNENSILTVSTYLDGQYGADDVYIGVPAVVNRGGIAGITELNLNEKEKEQFLHSAGVLKNILKPHFAEQKVN

SEQ ID NO: 288 - protein, 353 aa, Bacillus subtilis
MTHTVPQNMKAAVMHNTREIKIETLPVPDINHDEVLIKVMAVGICGSDLHYYTNGRIGNYVVEKPFILGHECAGEIAAVGSSVDQFKVGDRVAVEPGVTCGRCEACKEGRYNLCPDVQFLATPPVDGAFVQYIKMRQDFVFLIPDSLSYEEAALIEPFSVGIHAAARTKLQPGSTIAIMGMGPVGLMAVAAAKAFGAGTIIVTDLEPLRLEAAKKMGATHIINIREQDALEEIKTITNDRGVDVAWETAGNPAALQSALASVRRGGKLAIVGLPSQNEIPLNVPFIADNEIDIYGIFRYANTYPKGIEFLASGIVDTKHLVTDQYSLEQTQDAMERALQFKNECLKVMVYPNR

SEQ ID NO: 289 - DNA, 37 bp, Artificial Sequence
  Synthetic primer
acaaaaacatcagccatgggaaaagaaaaaaagtatg

SEQ ID NO: 290 - DNA, 36 bp, Artificial Sequence
  Synthetic primer
cgactctagaggatcttaatattttgtcgtcagctc

SEQ ID NO: 291 - protein, 321 aa, Bacillus subtilis; identical to SEQ ID NO: 287

SEQ ID NO: 292 - protein, 287 aa, Bacillus subtilis; identical to SEQ ID NO: 278

SEQ ID NO: 293 - protein, 321 aa, Bacillus subtilis
MMNKHVNKVALIGAGFVGSSYAFALINQGITDELVVIDVNKEKAMGDVMDLNHGKAFAPQPVKTSYGTYEDCKDADIVCICAGANQKPGETRLELVEKNLKIFKGIVSEVMASGFDGIFLIATNPVDILTYATWKFSGLPKERVIGSGTTLDSARFRFMLSEYFGAAPQNVHAHIIGEHGDTELPVWSHANVGGVPVSELVEKNDAYKQEELDQIVDDVKNAAYHIIEKKGATYYGVAMSLARITKAILHNENSILTVSTYLDGQYGADDVYIGVPAVVNRGGIAGITELNLNEKEKEQFLHSAGVLKNILKPHFAEQKVN

SEQ ID NO: 294 - DNA, 1266 bp, Pseudommas putida
atgagcaaaagcccgctgcgcgtggcggtgattggcggcggcattgcgggcaccgcgctggcgctgggcctgagcaaaagcagccatgtgaacgtgaaactgtttgaaaccgcgccggcgtttggcgaaattggcgcgggcgtgagctttggcgtgaacgcggtggaagcgattcagcgcctgggcattggcgaactgtataaaagcgtggcggatagcaccccggcgccgtggcaggatatttggctggaatggcgccatgcgcatgatgcgagcctggtgggcgcgaccgtggcgccgggcattggccagagcagcattcatcgcgcggattttattgatatgctggaaaaacgcctgccggcgggcattgcgagcctgggcaaacatgtggtggattataccgaaaacgcggaaggcgtgaccctgaactttgcggatggcagcacctataccgcggatgtggcgattgcggcggatggcattaaaagcagcatgcgcaacaccctgctgcgcgcggcgggccatgatgcggtgcatccgcagtttaccggcaccagcgcgtatcgcggcctggtggaaaccagcgcgctgcgcgaagcgtatcaggcggcgagcctggatgaacatctgctgaacgtgccgcagatgtatctgattgaagatggccatgtgctgacctttccggtgaaaaaaggcaaactgattattattgtggcgtttgtgagcgatcgcagcgtggcgaaaccgcagtggccgagcgatcagccgtgggtgcgcccggcgaccaccgatgaaatgctgcatcgctttgcgggcgcgggcgaagcggtgaaaaccctgctgaccagcattaaaagcccgaccctgtgggcgctgcatgattttgatccgctgccgacctatgtgcatggccgcgtggcgctgattggcgatgcggcgcatgcgatgctgccgcatcagggcgcgggcgcgggccagggcctggaagatgcgtattttatggcggaactgctgggcaacccgctgcatgaagcgagcgatattccggcgctgctggaagtgtatgatgatgtgcgccgcggccgcgcgagcaaagtgcagctgaccagccgcgaagcgggcgaactgtatgaatatcgcaccccgggcgtggaacgcgataccgcgaaactgaaagcgctgctggaaagccgcatgaactggatttggaactatgatctgggcgcggaagcgcgcctggcggtgaaaccggcgctggcgtaa

SEQ ID NO: 295 - DNA, 1266 bp, Pseudommas putida
atgagcaaaagcccgctgcgcgtggcggtgattggcggcggcattgcgggcaccgcgctggcgctgggcctgagcaaaagcagccatgtgaacgtgaaactgtttgaaaccgcgccggcgtttggcgaaattggcgcgggcgtgagctttggcgtgaacgcggtggaagcgattcagcgcctgggcattggcgaactgtataaaagcgtggcggatagcaccccggcgccgtggcaggatatttggattgaatggcgccatgcgcatgatgcgagcctggtgggcgcgaccgtggcgccgggcattggccagagcagcattcatcgcgcggattttattgatatgctggaaaaacgcctgccggcgggcattgcgagcctgggcaaacatgtggtggattataccgaaaacgcggaaggcgtgaccctgaactttgcggatggcagcacctataccgcggatgtggcgattgcggcggatggcattaaaagcagcatgcgcaacaccctgctgcgcgcggcgggccatgatgcggtgcatccgcagtttaccggcaccagcgcgtatcgcggcctggtggaaaccagcgcgctgcgcgaagcgtatcaggcggcgagcctggatgaacatctgctgaacgtgccgcagatgtatctgattgaagatggccatgtgctgacctttccggtgaaaaaaggcaaactgattattattgtggcgtttgtgagcgatcgcagcgtggcgaaaccgcagtggccgagcgatcagccgtgggtgcgcccggcgaccaccgatgaaatgctgcatcgctttgcgggcgcgggcgaagcggtgaaaaccctgctgaccagcattaaaagcccgaccctgtgggcgctgcatgattttgatccgctgccgacctatgtgcatggccgcgtggcgctgattggcgatgcggcgcatgcgatgctgccgcatcagggcgcgggcgcgggccagggcctggaagatgcgtattttatggcggaactgctgggcaacccgctgcatgaagcgagcgatattccggcgctgctggaagtgtatgatgatgtgcgccgcggccgcgcgagcaaagtgcagctgaccagccgcgaagcgggcgaactgtatgaatatcgcaccccgggcgtggaacgcgataccgcgaaactgaaagcgctgctggaaagccgcatgaactggatttggaactatgatctgggcgcggaagcgcgcctggcggtgaaaccggcgctggcgtaa

SEQ ID NO: 296 - DNA, 1266 bp, Pseudommas putida
atgagcaaaagcccgctgcgcgtggcggtgattggcggcggcattgcgggcaccgcgctggcgctgggcctgagcaaaagcagccatgtgaacgtgaaactgtttgaaaccgcgccggcgtttggcgaaattggcgcgggcgtgagctttggcgtgaacgcggtggaagcgattcagcgcctgggcattggcgaactgtataaaagcgtggcggatagcaccccggcgccgtggcaggatatttggtttgaatggcgccatgcgcatgatgcgagcctggtgggcgcgaccgtggcgccgggcattggccagagcagcattcatcgcgcggattttattgatatgctggaaaaacgcctgccggcgggcattgcgagcctgggcaaacatgtggtggattataccgaaaacgcggaaggcgtgaccctgaactttgcggatggcagcacctataccgcggatgtggcgattgcggcggatggcattaaaagcagcatgcgcaacaccctgctgcgcgcggcgggccatgatgcggtgcatccgcagtttaccggcaccagcgcgtatcgcggcctggtggaaaccagcgcgctgcgcgaagcgtatcaggcggcgagcctggatgaacatctgctgaacgtgccgcagatgtatctgattgaagatggccatgtgctgacctttccggtgaaaaaaggcaaactgattattattgtggcgctggtgagcgatcgcagcgtggcgaaaccgcagtggccgagcgatcagccgtgggtgcgcccggcgaccaccgatgaaatgctgcatcgctttgcgggcgcgggcgaagcggtgaaaaccctgctgaccagcattaaaagcccgaccctgtgggcgctgcatgattttgatccgctgccgacctatgtgcatggccgcgtggcgctgattggcgatgcggcgcatgcgatgctgccgcatcagggcgcgggcgcgggccagggcctggaagatgcgtattttatggcggaactgctgggcaacccgctgcatgaagcgagcgatattccggcgctgctggaagtgtatgatgatgtgcgccgcggccgcgcgagcaaagtgcagctgaccagccgcgaagcgggcgaactgtatgaatatcgcaccccgggcgtggaacgcgataccgcgaaactgaaagcgctgctggaaagccgcatgaactggatttggaactatgatctgggcgcggaagcgcgcctggcggtgaaaccggcgctggcgtaa

SEQ ID NO: 297 - DNA, 1266 bp, Pseudommas putida
atgagcaaaagcccgctgcgcgtggcggtgattggcggcggcattgcgggcaccgcgctggcgctgggcctgagcaaaagcagccatgtgaacgtgaaactgtttgaaaccgcgccggcgtttggcgaaattggcgcgggcgtgagctttggcgtgaacgcggtggaagcgattcagcgcctgggcattggcgaactgtataaaagcgtggcggatagcaccccggcgccgtggcaggatatttggtttgaatggcgccatgcgcatgatgcgagcctggtgggcgcgaccgtggcgccgggcattggccagagcagcattcatcgcgcggattttattgatatgctggaaaaacgcctgccggcgggcattgcgagcctgggcaaacatgtggtggattataccgaaaacgcggaaggcgtgaccctgaactttgcggatggcagcacctataccgcggatgtggcgattgcggcggatggcattaaaagcagcatgcgcaacaccctgctgcgcgcggcgggccatgatgcggtgcatccgcagtttaccggcaccagcgcgtatcgcggcctggtggaaaccagcgcgctgcgcgaagcgtatcaggcggcgagcctggatgaacatctgctgaacgtgccgcagatgtatctgattgaagatggccatgtgctgacctttccggtgaaaaaaggcaaactgattattattgtggcgattgtgagcgatcgcagcgtggcgaaaccgcagtggccgagcgatcagccgtgggtgcgcccggcgaccaccgatgaaatgctgcatcgctttgcgggcgcgggcgaagcggtgaaaaccctgctgaccagcattaaaagcccgaccctgtgggcgctgcatgattttgatccgctgccgacctatgtgcatggccgcgtggcgctgattggcgatgcggcgcatgcgatgctgccgcatcagggcgcgggcgcgggccagggcctggaagatgcgtattttatggcggaactgctgggcaacccgctgcatgaagcgagcgatattccggcgctgctggaagtgtatgatgatgtgcgccgcggccgcgcgagcaaagtgcagctgaccagccgcgaagcgggcgaactgtatgaatatcgcaccccgggcgtggaacgcgataccgcgaaactgaaagcgctgctggaaagccgcatgaactggatttggaactatgatctgggcgcggaagcgcgcctggcggtgaaaccggcgctggcgtaa

SEQ ID NO: 298 - DNA, 1266 bp, Pseudommas putida
atgagcaaaagcccgctgcgcgtggcggtgattggcggcggcattgcgggcaccgcgctggcgctgggcctgagcaaaagcagccatgtgaacgtgaaactgtttgaaaccgcgccggcgtttggcgaaattggcgcgggcgtgagctttggcgtgaacgcggtggaagcgattcagcgcctgggcattggcgaactgtataaaagcgtggcggatagcaccccggcgccgtggcaggatatttggctggaatggcgccatgcgcatgatgcgagcctggtgggcgcgaccgtggcgccgggcattggccagagcagcattcatcgcgcggattttattgatatgctggaaaaacgcctgccggcgggcattgcgagcctgggcaaacatgtggtggattataccgaaaacgcggaaggcgtgaccctgaactttgcggatggcagcacctataccgcggatgtggcgattgcggcggatggcattaaaagcagcatgcgcaacaccctgctgcgcgcggcgggccatgatgcggtgcatccgcagtttaccggcaccagcgcgtatcgcggcctggtggaaaccagcgcgctgcgcgaagcgtatcaggcggcgagcctggatgaacatctgctgaacgtgccgcagatgtatctgattgaagatggccatgtgctgacctttccggtgaaaaaaggcaaactgattattattgtggcgctggtgagcgatcgcagcgtggcgaaaccgcagtggccgagcgatcagccgtgggtgcgcccggcgaccaccgatgaaatgctgcatcgctttgcgggcgcgggcgaagcggtgaaaaccctgctgaccagcattaaaagcccgaccctgtgggcgctgcatgattttgatccgctgccgacctatgtgcatggccgcgtggcgctgattggcgatgcggcgcatgcgatgctgccgcatcagggcgcgggcgcgggccagggcctggaagatgcgtattttatggcggaactgctgggcaacccgctgcatgaagcgagcgatattccggcgctgctggaagtgtatgatgatgtgcgccgcggccgcgcgagcaaagtgcagctgaccagccgcgaagcgggcgaactgtatgaatatcgcaccccgggcgtggaacgcgataccgcgaaactgaaagcgctgctggaaagccgcatgaactggatttggaactatgatctgggcgcggaagcgcgcctggcggtgaaaccggcgctggcgtaa

SEQ ID NO: 299 - DNA, 1266 bp, Pseudommas putida
atgagcaaaagcccgctgcgcgtggcggtgattggcggcggcattgcgggcaccgcgctggcgctgggcctgagcaaaagcagccatgtgaacgtgaaactgtttgaaaccgcgccggcgtttggcgaaattggcgcgggcgtgagctttggcgtgaacgcggtggaagcgattcagcgcctgggcattggcgaactgtataaaagcgtggcggatagcaccccggcgccgtggcaggatatttggattgaatggcgccatgcgcatgatgcgagcctggtgggcgcgaccgtggcgccgggcattggccagagcagcattcatcgcgcggattttattgatatgctggaaaaacgcctgccggcgggcattgcgagcctgggcaaacatgtggtggattataccgaaaacgcggaaggcgtgaccctgaactttgcggatggcagcacctataccgcggatgtggcgattgcggcggatggcattaaaagcagcatgcgcaacaccctgctgcgcgcggcgggccatgatgcggtgcatccgcagtttaccggcaccagcgcgtatcgcggcctggtggaaaccagcgcgctgcgcgaagcgtatcaggcggcgagcctggatgaacatctgctgaacgtgccgcagatgtatctgattgaagatggccatgtgctgacctttccggtgaaaaaaggcaaactgattattattgtggcgattgtgagcgatcgcagcgtggcgaaaccgcagtggccgagcgatcagccgtgggtgcgcccggcgaccaccgatgaaatgctgcatcgctttgcgggcgcgggcgaagcggtgaaaaccctgctgaccagcattaaaagcccgaccctgtgggcgctgcatgattttgatccgctgccgacctatgtgcatggccgcgtggcgctgattggcgatgcggcgcatgcgatgctgccgcatcagggcgcgggcgcgggccagggcctggaagatgcgtattttatggcggaactgctgggcaacccgctgcatgaagcgagcgatattccggcgctgctggaagtgtatgatgatgtgcgccgcggccgcgcgagcaaagtgcagctgaccagccgcgaagcgggcgaactgtatgaatatcgcaccccgggcgtggaacgcgataccgcgaaactgaaagcgctgctggaaagccgcatgaactggatttggaactatgatctgggcgcggaagcgcgcctggcggtgaaaccggcgctggcgtaa

SEQ ID NO: 300 - protein, 421 aa, Pseudommas putida
MSKSPLRVAVIGGGIAGTALALGLSKSSHVNVKLFETAPAFGEIGAGVSFGVNAVEAIQRLGIGELYKSVADSTPAPWQDIWLEWRHAHDASLVGATVAPGIGQSSIHRADFIDMLEKRLPAGIASLGKHVVDYTENAEGVTLNFADGSTYTADVAIAADGIKSSMRNTLLRAAGHDAVHPQFTGTSAYRGLVETSALREAYQAASLDEHLLNVPQMYLIEDGHVLTFPVKKGKLIIIVAFVSDRSVAKPQWPSDQPWVRPATTDEMLHRFAGAGEAVKTLLTSIKSPTLWALHDFDPLPTYVHGRVALIGDAAHAMLPHQGAGAGQGLEDAYFMAELLGNPLHEASDIPALLEVYDDVRRGRASKVQLTSREAGELYEYRTPGVERDTAKLKALLESRMNWIWNYDLGAEARLAVKPALA

SEQ ID NO: 301 - protein, 421 aa, Pseudommas putida
MSKSPLRVAVIGGGIAGTALALGLSKSSHVNVKLFETAPAFGEIGAGVSFGVNAVEAIQRLGIGELYKSVADSTPAPWQDIWIEWRHAHDASLVGATVAPGIGQSSIHRADFIDMLEKRLPAGIASLGKHVVDYTENAEGVTLNFADGSTYTADVAIAADGIKSSMRNTLLRAAGHDAVHPQFTGTSAYRGLVETSALREAYQAASLDEHLLNVPQMYLIEDGHVLTFPVKKGKLIIIVAFVSDRSVAKPQWPSDQPWVRPATTDEMLHRFAGAGEAVKTLLTSIKSPTLWALHDFDPLPTYVHGRVALIGDAAHAMLPHQGAGAGQGLEDAYFMAELLGNPLHEASDIPALLEVYDDVRRGRASKVQLTSREAGELYEYRTPGVERDTAKLKALLESRMNWIWNYDLGAEARLAVKPALA

SEQ ID NO: 302 - protein, 421 aa, Pseudommas putida
MSKSPLRVAVIGGGIAGTALALGLSKSSHVNVKLFETAPAFGEIGAGVSFGVNAVEAIQRLGIGELYKSVADSTPAPWQDIWFEWRHAHDASLVGATVAPGIGQSSIHRADFIDMLEKRLPAGIASLGKHVVDYTENAEGVTLNFADGSTYTADVAIAADGIKSSMRNTLLRAAGHDAVHPQFTGTSAYRGLVETSALREAYQAASLDEHLLNVPQMYLIEDGHVLTFPVKKGKLIIIVALVSDRSVAKPQWPSDQPWVRPATTDEMLHRFAGAGEAVKTLLTSIKSPTLWALHDFDPLPTYVHGRVALIGDAAHAMLPHQGAGAGQGLEDAYFMAELLGNPLHEASDIPALLEVYDDVRRGRASKVQLTSREAGELYEYRTPGVERDTAKLKALLESRMNWIWNYDLGAEARLAVKPALA

SEQ ID NO: 303 - protein, 421 aa, Pseudommas putida
MSKSPLRVAVIGGGIAGTALALGLSKSSHVNVKLFETAPAFGEIGAGVSFGVNAVEAIQRLGIGELYKSVADSTPAPWQDIWFEWRHAHDASLVGATVAPGIGQSSIHRADFIDMLEKRLPAGIASLGKHVVDYTENAEGVTLNFADGSTYTADVAIAADGIKSSMRNTLLRAAGHDAVHPQFTGTSAYRGLVETSALREAYQAASLDEHLLNVPQMYLIEDGHVLTFPVKKGKLIIIVAIVSDRSVAKPQWPSDQPWVRPATTDEMLHRFAGAGEAVKTLLTSIKSPTLWALHDFDPLPTYVHGRVALIGDAAHAMLPHQGAGAGQGLEDAYFMAELLGNPLHEASDIPALLEVYDDVRRGRASKVQLTSREAGELYEYRTPGVERDTAKLKALLESRMNWIWNYDLGAEARLAVKPALA

SEQ ID NO: 304 - protein, 421 aa, Pseudommas putida
MSKSPLRVAVIGGGIAGTALALGLSKSSHVNVKLFETAPAFGEIGAGVSFGVNAVEAIQRLGIGELYKSVADSTPAPWQDIWLEWRHAHDASLVGATVAPGIGQSSIHRADFIDMLEKRLPAGIASLGKHVVDYTENAEGVTLNFADGSTYTADVAIAADGIKSSMRNTLLRAAGHDAVHPQFTGTSAYRGLVETSALREAYQAASLDEHLLNVPQMYLIEDGHVLTFPVKKGKLIIIVALVSDRSVAKPQWPSDQPWVRPATTDEMLHRFAGAGEAVKTLLTSIKSPTLWALHDFDPLPTYVHGRVALIGDAAHAMLPHQGAGAGQGLEDAYFMAELLGNPLHEASDIPALLEVYDDVRRGRASKVQLTSREAGELYEYRTPGVERDTAKLKALLESRMNWIWNYDLGAEARLAVKPALA

SEQ ID NO: 305 - protein, 421 aa, Pseudommas putida
MSKSPLRVAVIGGGIAGTALALGLSKSSHVNVKLFETAPAFGEIGAGVSFGVNAVEAIQRLGIGELYKSVADSTPAPWQDIWIEWRHAHDASLVGATVAPGIGQSSIHRADFIDMLEKRLPAGIASLGKHVVDYTENAEGVTLNFADGSTYTADVAIAADGIKSSMRNTLLRAAGHDAVHPQFTGTSAYRGLVETSALREAYQAASLDEHLLNVPQMYLIEDGHVLTFPVKKGKLIIIVAIVSDRSVAKPQWPSDQPWVRPATTDEMLHRFAGAGEAVKTLLTSIKSPTLWALHDFDPLPTYVHGRVALIGDAAHAMLPHQGAGAGQGLEDAYFMAELLGNPLHEASDIPALLEVYDDVRRGRASKVQLTSREAGELYEYRTPGVERDTAKLKALLESRMNWIWNYDLGAEARLAVKPALA

What is claimed is:

1. A composition comprising a carrier and an enzyme that comprises an amino acid sequence having 100% identity to SEQ ID NO: 251, wherein:
    the carrier comprises a preservative, a bactericide or a combination thereof; and/or
    the composition further comprises a co-factor regenerating enzyme.

2. A composition of claim 1, wherein the carrier comprises an agriculturally acceptable carrier.

3. A composition of claim 1, wherein the carrier is not associated with the enzyme in nature.

4. A composition of claim 1, wherein the carrier further comprises a surfactant, a metal salt, a metal ion, or a combination of any thereof.

5. A composition of claim 1, wherein the composition comprises the cofactor-regenerating enzyme.

6. A composition claim 5, wherein the cofactor-regenerating enzyme comprises a sorbitol dehydrogenase.

7. A composition of claim 6, wherein
the sorbitol dehydrogenase comprises an amino acid sequence comprising any one of SEQ ID NOs. 220, 287, and 288.

8. A composition of claim 1, wherein the composition further comprises a colorimetric detection agent.

9. A composition of claim 8, wherein the colorimetric detection agent can be used to visualize detoxification of an auxin herbicide by the enzyme or degradation of an auxin plant growth regulator by the enzyme.

10. A composition of claim 1, wherein the enzyme is capable of detoxifying an auxin herbicide, degrading an auxin plant growth regulator, or a combination thereof.

11. A composition of claim 10, wherein the auxin herbicide comprises a benzoic acid herbicide or a phenoxy herbicide.

12. A composition of claim 11, wherein the benzoic acid herbicide comprises dicamba, chloramben, 2,3,6-trichlorobenzoic acid (2,3,6-TBA), a salt of any thereof, an ester of any thereof, or a combination of any thereof; and/or wherein the phenoxy herbicide comprises 2,4-dichlorophenoxyacetic acid (2,4-D), 2-methyl-4-chlorophenoxyacetic acid (MCPA), 4-(4-chloro-o-tolyloxy)butyric acid (MCPB), mecoprop, 4-(2,4-dichlorophenoxy)butyric acid (2,4-DB), dichlorprop, dichlorprop-p, mecoprop-p, a salt of any thereof, an ester of any thereof, or a combination of any thereof.

13. A composition of claim 1, wherein the enzyme comprises an enzyme that is immobilized on a matrix, support, or particle.

14. The composition of claim 1, wherein the composition further comprises a cofactor.

15. The composition of claim 2, wherein the carrier further comprises a buffering agent, a compatibility agent, a spray drift reduction agent, or a combination of any thereof.

16. The composition of claim 10, wherein the composition further comprises an additional enzyme, wherein the additional enzyme is capable of detoxifying the auxin herbicide, degrading the auxin plant growth regulator, or a combination thereof.

17. A method for detoxifying an auxin herbicide or degrading an auxin plant growth regulator, the method comprising contacting the auxin herbicide or the auxin plant growth regulator with the composition of claim 1.

* * * * *